US009636396B2

(12) United States Patent
Heidmann

(10) Patent No.: US 9,636,396 B2
(45) Date of Patent: May 2, 2017

(54) MUTANT HUMAN AND SIMIAN IMMUNODEFICIENCY VIRUS ENV PROTEINS WITH REDUCED IMMUNOSUPPRESSIVE PROPERTIES

(71) Applicants: CENTRE NATIONAL DE LA RECHERCHE SCIENTIFIQUE, Paris (FR); UNIVERSITE PARIS-SUD XI, Orsay (FR); INSTITUT GUSTAVE ROUSSY, Villejuif (FR); VIROXIS S.A.S., Paris (FR)

(72) Inventor: Thierry Heidmann, Paris (FR)

(73) Assignees: CENTRE NATIONAL DE LA RECHERCHE SCIENTIFIQUE, Paris (FR); UNIVERSITE PARIS-SUD XI, Orsay (FR); INSITUT GUSTAVE ROUSSY, Villejuif (FR); VIROXIS S.A.S., Paris (FR)

( * ) Notice: Subject to any disclaimer, the term of this patent is extended or adjusted under 35 U.S.C. 154(b) by 0 days.

(21) Appl. No.: 13/707,885

(22) Filed: Dec. 7, 2012

(65) Prior Publication Data

US 2013/0149323 A1 Jun. 13, 2013

Related U.S. Application Data

(60) Provisional application No. 61/567,810, filed on Dec. 7, 2011.

(51) Int. Cl.

| | |
|---|---|
| ***A61K 39/21*** | (2006.01) |
| ***C07K 14/16*** | (2006.01) |
| ***C07K 7/06*** | (2006.01) |
| ***C07K 7/08*** | (2006.01) |
| ***C07K 14/005*** | (2006.01) |
| ***A61K 39/12*** | (2006.01) |

(52) U.S. Cl.

CPC .............. *A61K 39/21* (2013.01); *A61K 39/12* (2013.01); *C07K 14/005* (2013.01); *C07K 7/06* (2013.01); *C07K 7/08* (2013.01); *C07K 14/162* (2013.01); *C12N 2740/15022* (2013.01); *C12N 2740/15033* (2013.01); *C12N 2740/15034* (2013.01); *C12N 2740/16022* (2013.01); *C12N 2740/16034* (2013.01); *C12N 2740/16111* (2013.01); *C12N 2740/16122* (2013.01); *C12N 2740/16134* (2013.01)

(58) Field of Classification Search

CPC ...... A61K 39/12; A61K 39/21; C07K 14/162; C07K 7/06; C07K 7/08; C12N 2740/16111; C12N 2740/16122; C12N 2740/15033

See application file for complete search history.

(56) References Cited

FOREIGN PATENT DOCUMENTS

| | | | |
|---|---|---|---|
| WO | 2005/012502 | A2 | 2/2005 |
| WO | 2005/095442 | A1 | 10/2005 |
| WO | 2010/022740 | A2 | 3/2010 |

OTHER PUBLICATIONS

Duenas-Decamp, M. J., et al., Mar. 2009, Determinants flanking the CD4 binding loop modulate macrophage tropism of human immunodeficiency virus type 1 R5 envelopes, J. Virol. 83(6):2575-2583.*
Barouch, D. H., 2008,Challenges in the development of an HIV-1 vaccine, Nature 455:613-619.*
Haynes, B. F., 2006, Aiming to induce broadly reactive neutralizing antibody responses with HIV-1 vaccine candidates, Expert Rev. Vaccines 5(3):347-363.*
Denner J et al.: "The Immunosuppressive Peptide of HIV-1:Functional Domains and Immune Response in AIDS Patients", AIDS, Philadelphia, PA, US, vol. 8, No. 8, Aug. 1, 1994 (Aug. 1, 1994), pp. 1063-1072, XP080647542.
Schlecht-Louf et al.: "Retroviral infection in vivo requires an immune escape virulence factor encrypted in the envelope protein of oncoretroviruses", Proc Natl Acad Sci USA., vol. 107, No. 8, 2010, pp. 3782-3787, XP002675453.
Database UniProt [Online] Oct. 19, 2011 (Oct. 19, 2011), "SubName: Full=Envelope glycoprotein; Flags: Fragment", XP002675454, retrieved from EBI accession No. UNIPROT:G1JQN5 Database accession No. G1JQN5.
Database UniProt [Online] Jun. 15, 2010 (Jun. 15, 2010), "SubName: Full=Cell division protein FtsY; Pprevptept Trlaklrnrl Aksnnamgrg Llallsrdtl Deatweeied Tlivadlgvd", XP002675455, retrieved from EBI accession No. UNIPROT:D4YP64 Database accession No. D4YP64.
Partial European Search Report, dated May 8, 2012, from corresponding EP 11 38 6625.

* cited by examiner

*Primary Examiner* — Jeffrey Parkin
(74) *Attorney, Agent, or Firm* — Young & Thompson

(57) ABSTRACT

A pharmaceutical composition includes, as active substance a mutated lentiviral ENV protein, substantially devoid of immunosuppressive properties or a variant of the mutated lentiviral ENV protein or a fragment of the above proteins, in association with a pharmaceutically acceptable carrier.

26 Claims, 7 Drawing Sheets

SGIVQQQNNLLRAIEAQQHLLQLTVWGIKQ HIV30 (SEQ ID NO : 431)
SGIVQQQNNLLRAIEAQQHLLQLTVWGIKQLQARILA HIV37 (SEQ ID NO : 432)
SGIVQQQNNLLRAIEAQQHLLQLTVWGIKQLQARILAVERYLK HIV43(SEQ ID NO : 433)
SGIVQQQNNLLRAIEAQQHLLQLTVWGIKQLQARILAVERYLKDQQLLG HIV49(SEQ ID NO : 434)
SGIVQQQNNLLRAIEAQQHLLQLTVWGIKQLQARILAVERYLKDQQLLGIWGCSG HIV55 (SEQ ID NO : 435)
SGIVQQQNNLLRAIEAQQHLLQLTVWGIKQLQARILAVERYLKDQQLLGIWGCSGKLICTTAVPWNA HIV67 (SEQ ID NO : 436)
SGIVQQQNNLLRAIEAQQHLLQLTVWGIKQLQARILAVERYLKDQQLLGIWGCSGKLICTTAVPWNASWSNKSLEQIWNNM HIV81 (SEQ ID NO : 437)

SGIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQ
EL HIV115 (SEQ ID NO : 438)
SGIVQQQNNLLRAIEAQQHLLQLTVWGIKQLQARIRAVERYLKDQQLLGIWGCSGKLICTTAVPWNASWSNKSLEQIWNNMTWMEWDREINNYTSLIHSLIEESQNQQEKNEQ
EL 115 L36R (SEQ ID NO : 439)
SGIVQQQNNLLRAIEAQQHLLQLTVWGIKQLQARILRVERYLKDQQLLGIWGCSGKLICTTAVPWNASWSNKSLEQIWNNMTWMEWDREINNYTSLIHSLIEESQNQQEKNEQ
EL 115 A37R (SEQ ID NO : 440)
SGIVQQQNNLLRAIEAQQHLLQLTVWGIKQLQARILARERYLKDQQLLGIWGCSGKLICTTAVPWNASWSNKSLEQIWNNMTWMEWDREINNYTSLIHSLIEESQNQQEKNEQ
EL 115 V38R (SEQ ID NO : 441)
SGIVQQQNNLLRAIEAQQHLLQLTVWGIKQLQARILAVRRYLKDQQLLGIWGCSGKLICTTAVPWNASWSNKSLEQIWNNMTWMEWDREINNYTSLIHSLIEESQNQQEKNEQ
EL 115 E39R (SEQ ID NO : 442)
SGIVQQQNNLLRAIEAQQHLLQLTVWGIKQLQARILAVERRLKDQQLLGIWGCSGKLICTTAVPWNASWSNKSLEQIWNNMTWMEWDREINNYTSLIHSLIEESQNQQEKNEQ
EL 115 Y41R (SEQ ID NO : 443)
SGIVQQQNNLLRAIEAQQHLLQLTVWGIKQLQARILAVERYRKDQQLLGIWGCSGKLICTTAVPWNASWSNKSLEQIWNNMTWMEWDREINNYTSLIHSLIEESQNQQEKNEQ
EL 115 L42R (SEQ ID NO : 444)
SGIVQQQNNLLRAIEAQQHLLQLTVWGIKQLQARILAVERYLRDQQLLGIWGCSGKLICTTAVPWNASWSNKSLEQIWNNMTWMEWDREINNYTSLIHSLIEESQNQQEKNEQ
EL 115 K43R (SEQ ID NO : 445)
SGIVQQQNNLLRAIEAQQHLLQLTVWGIKQLQARILAVERYLKRQQLLGIWGCSGKLICTTAVPWNASWSNKSLEQIWNNMTWMEWDREINNYTSLIHSLIEESQNQQEKNEQ
EL 115 D44R (SEQ ID NO : 446)
SGIVQQQNNLLRAIEAQQHLLQLTVWGIKQLQARILAVERYLKDRQLLGIWGCSGKLICTTAVPWNASWSNKSLEQIWNNMTWMEWDREINNYTSLIHSLIEESQNQQEKNEQ
EL 115 Q45R (SEQ ID NO : 447)
SGIVQQQNNLLRAIEAQQHLLQLTVWGIKQLQARILAVERYLKDQRLLGIWGCSGKLICTTAVPWNASWSNKSLEQIWNNMTWMEWDREINNYTSLIHSLIEESQNQQEKNEQ
EL 115 Q46R (SEQ ID NO : 448)
SGIVQQQNNLLRAIEAQQHLLQLTVWGIKQLQARILAVERYLKDQQRLGIWGCSGKLICTTAVPWNASWSNKSLEQIWNNMTWMEWDREINNYTSLIHSLIEESQNQQEKNEQ
EL 115 L47R (SEQ ID NO : 449)
SGIVQQQNNLLRAIEAQQHLLQLTVWGIKQLQARILAVERYLKDQQLRGIWGCSGKLICTTAVPWNASWSNKSLEQIWNNMTWMEWDREINNYTSLIHSLIEESQNQQEKNEQ
EL 115 L48R (SEQ ID NO : 450)
SGIVQQQNNLLRAIEAQQHLLQLTVWGIKQLQARILAVERYLKDQQLLRIWGCSGKLICTTAVPWNASWSNKSLEQIWNNMTWMEWDREINNYTSLIHSLIEESQNQQEKNEQ
EL 115 G49R (SEQ ID NO : 451)
SGIVQQQNNLLRAIEAQQHLLQLTVWGIKQLQARILAVERYLKDQQLLGRWGCSGKLICTTAVPWNASWSNKSLEQIWNNMTWMEWDREINNYTSLIHSLIEESQNQQEKNE
QEL 115 I50R (SEQ ID NO : 452)
SGIVQQQNNLLRAIEAQQHLLQLTVWGIKQLQARILAVERYLKDQQLLGIRGCSGKLICTTAVPWNASWSNKSLEQIWNNMTWMEWDREINNYTSLIHSLIEESQNQQEKNEQ
EL 115 W51R (SEQ ID NO : 453)

Figure 1(first part)

SGIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQ
EL HIV115 (SEQ ID NO : 438)

SGIVQQQNNLLRAIEAQQHLLQLTVWGIKQLQARILAVERRLKDQQLLGIWGCSGKLICTTAVPWNASWSNKSLEQIWNNMTWMEWDREINNYTSLIHSLIEESQNQQEKNEQ
EL 115 Y41R (SEQ ID NO : 443)

SGIVQQQNNLLRAIEAQQHLLQLTVWGIKQLQARILAVERHLKDQQLLGIWGCSGKLICTTAVPWNASWSNKSLEQIWNNMTWMEWDREINNYTSLIHSLIEESQNQQEKNEQ
EL 115 Y41H (SEQ ID NO : 454)

SGIVQQQNNLLRAIEAQQHLLQLTVWGIKQLQARILAVERKLKDQQLLGIWGCSGKLICTTAVPWNASWSNKSLEQIWNNMTWMEWDREINNYTSLIHSLIEESQNQQEKNEQ
EL 115 Y41K (SEQ ID NO : 455)

SGIVQQQNNLLRAIEAQQHLLQLTVWGIKQLQARILAVERGLKDQQLLGIWGCSGKLICTTAVPWNASWSNKSLEQIWNNMTWMEWDREINNYTSLIHSLIEESQNQQEKNEQ
EL 115 Y41G (SEQ ID NO : 456)

SGIVQQQNNLLRAIEAQQHLLQLTVWGIKQLQARILAVERLLKDQQLLGIWGCSGKLICTTAVPWNASWSNKSLEQIWNNMTWMEWDREINNYTSLIHSLIEESQNQQEKNEQ
EL 115 Y41L (SEQ ID NO : 457)

SGIVQQQNNLLRAIEAQQHLLQLTVWGIKQLQARILAVERALKDQQLLGIWGCSGKLICTTAVPWNASWSNKSLEQIWNNMTWMEWDREINNYTSLIHSLIEESQNQQEKNEQ
EL 115 Y41A (SEQ ID NO : 458)

SGIVQQQNNLLRAIEAQQHLLQLTVWGIKQLQARILAVERFLKDQQLLGIWGCSGKLICTTAVPWNASWSNKSLEQIWNNMTWMEWDREINNYTSLIHSLIEESQNQQEKNEQ
EL 115 Y41F (SEQ ID NO : 459)

Figure 1 (end)

SGIVQQQNNLLRAIEAQQHLLQLTVWGIKQ - HIV 30 (SEQ ID NO : 431)
SGIVQQQNNLLRAIEAQQHLLQLTVWGIKQLQARILA - HIV 37 (SEQ ID NO : 432)
SGIVQQQNNLLRAIEAQQHLLQLTVWGIKQLQARILAVERYLK - HIV 43 (SEQ ID NO : 433)
SGIVQQQNNLLRAIEAQQHLLQLTVWGIKQLQARILAVERYLKDQQLLG - HIV 49 (SEQ ID NO : 434)
SGIVQQQNNLLRAIEAQQHLLQLTVWGIKQLQARILAVERYLKDQQLLGIWGCSG - HIV 55 (SEQ ID NO : 435)
SGIVQQQNNLLRAIEAQQHLLQLTVWGIKQLQARILAVERYLKDQQLLGIWGCSGKLICTTAVPWNA - HIV 67 (SEQ ID NO : 436)
SGIVQQQNNLLRAIEAQQHLLQLTVWGIKQLQARILAVERYLKDQQLLGIWGCSGKLICTTAVPWNASWSNKSLEQIWNNM - HIV 81 (SEQ ID NO : 437)
SGIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQEL - HIV 115 (SEQ ID NO : 438)

SGIVQQQNNLLRAIEAQQHLLQLTVWGIKQLQARILAVERYLKDQQLLGIWGC...KNEQEL - HIV 115 (SEQ ID NO : 438)
SGIVQQQNNLLRAIEAQQHLLQLTVWGIKQLQARIRAVERYLKDQQLLGIWGC...KNEQEL - HIV 115 L36R (SEQ ID NO : 439)
SGIVQQQNNLLRAIEAQQHLLQLTVWGIKQLQARILRVERYLKDQQLLGIWGC...KNEQEL - HIV 115 A37R (SEQ ID NO : 440)
SGIVQQQNNLLRAIEAQQHLLQLTVWGIKQLQARILARERYLKDQQLLGIWGC...KNEQEL - HIV 115 V38R (SEQ ID NO : 441)
SGIVQQQNNLLRAIEAQQHLLQLTVWGIKQLQARILAVRRYLKDQQLLGIWGC...KNEQEL - HIV 115 E39R (SEQ ID NO : 442)
SGIVQQQNNLLRAIEAQQHLLQLTVWGIKQLQARILAVERRLKDQQLLGIWGC...KNEQEL - HIV 115 Y41R (SEQ ID NO : 443)
SGIVQQQNNLLRAIEAQQHLLQLTVWGIKQLQARILAVERRLKDQQLLGIWGC...KNEQEL - HIV 115 Y41R K72A (SEQ ID NO : 460)
SGIVQQQNNLLRAIEAQQHLLQLTVWGIKQLQARILAVERRLKDQQLLGIWGC...KNEQEL - HIV 115 Y41R K72G (SEQ ID NO : 461)
SGIVQQQNNLLRAIEAQQHLLQLTVWGIKQLQARILAVERRLKDQQLLGIWGC...KNEQEL - HIV 115 Y41R K72S (SEQ ID NO : 462)
SGIVQQQNNLLRAIEAQQHLLQLTVWGIKQLQARILAVERHLKDQQLLGIWGC...KNEQEL - HIV 115 Y41H (SEQ ID NO : 454)
SGIVQQQNNLLRAIEAQQHLLQLTVWGIKQLQARILAVERKLKDQQLLGIWGC...KNEQEL - HIV 115 Y41K (SEQ ID NO : 455)
SGIVQQQNNLLRAIEAQQHLLQLTVWGIKQLQARILAVERGLKDQQLLGIWGC...KNEQEL - HIV 115 Y41G (SEQ ID NO : 456)
SGIVQQQNNLLRAIEAQQHLLQLTVWGIKQLQARILAVERLLKDQQLLGIWGC...KNEQEL - HIV 115 Y41L (SEQ ID NO : 457)
SGIVQQQNNLLRAIEAQQHLLQLTVWGIKQLQARILAVERALKDQQLLGIWGC...KNEQEL - HIV 115 Y41A (SEQ ID NO : 458)
SGIVQQQNNLLRAIEAQQHLLQLTVWGIKQLQARILAVERFLKDQQLLGIWGC...KNEQEL - HIV 115 Y41F (SEQ ID NO : 459)
SGIVQQQNNLLRAIEAQQHLLQLTVWGIKQLQARILAVERYRKDQQLLGIWGC...KNEQEL - HIV 115 L42R (SEQ ID NO : 444)
SGIVQQQNNLLRAIEAQQHLLQLTVWGIKQLQARILAVERYLRDQQLLGIWGC...KNEQEL - HIV 115 K43R (SEQ ID NO : 445)
SGIVQQQNNLLRAIEAQQHLLQLTVWGIKQLQARILAVERYLKRQQLLGIWGC...KNEQEL - HIV 115 D44R (SEQ ID NO : 446)
SGIVQQQNNLLRAIEAQQHLLQLTVWGIKQLQARILAVERYLKDRQLLGIWGC...KNEQEL - HIV 115 Q45R (SEQ ID NO : 447)
SGIVQQQNNLLRAIEAQQHLLQLTVWGIKQLQARILAVERYLKDQRLLGIWGC...KNEQEL - HIV 115 Q46R (SEQ ID NO : 448)
SGIVQQQNNLLRAIEAQQHLLQLTVWGIKQLQARILAVERYLKDQQRLGIWGC...KNEQEL - HIV 115 L47R (SEQ ID NO : 449)
SGIVQQQNNLLRAIEAQQHLLQLTVWGIKQLQARILAVERYLKDQQLRGIWGC...KNEQEL - HIV 115 L48R (SEQ ID NO : 450)
SGIVQQQNNLLRAIEAQQHLLQLTVWGIKQLQARILAVERYLKDQQLLRIWGC...KNEQEL - HIV 115 G49R (SEQ ID NO : 451)
SGIVQQQNNLLRAIEAQQHLLQLTVWGIKQLQARILAVERYLKDQQLLGRWGC...KNEQEL - HIV 115 I50R (SEQ ID NO : 452)
SGIVQQQNNLLRAIEAQQHLLQLTVWGIKQLQARILAVERYLKDQQLLGIRGC...KNEQEL - HIV 115 W51R (SEQ ID NO : 453)

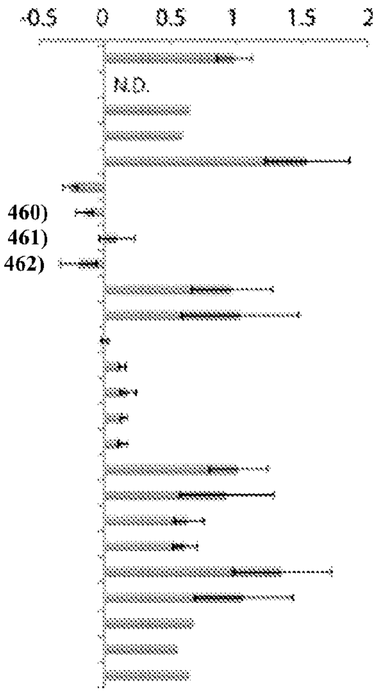

Figure 3

MUTANT HUMAN AND SIMIAN IMMUNODEFICIENCY VIRUS ENV PROTEINS WITH REDUCED IMMUNOSUPPRESSIVE PROPERTIES

An attached Sequence Listing (i. Name: Replacement Sequence 0508-1306-1, ii. Date of Creation: Mar. 20, 2015, and iii. Size: 712 KB) is based on the disclosure of the Sequences in the present specification and figures.

FIELD OF THE INVENTION

The present invention relates to mutated lentiviral ENV proteins and their use as drugs.

BACKGROUND OF THE INVENTION

Lentivirus is a genus of slow viruses of the Retroviridae family, characterized by a long incubation period. Lentiviruses can deliver a significant amount of genetic information into the DNA of the host cell and have the unique ability among retroviruses of being able to replicate in non-dividing cells, so they are one of the most efficient methods of a gene delivery vector. HIV, SIV, and FIV are all examples of lentiviruses.

Human immunodeficiency virus (HIV) is according to WHO one of the most serious health crisis the world faces today. AIDS has killed more than 25 million people since 1981. In the most severely affected countries, the average life expectancy is now declining to 49 years of age—13 years less than in the absence of AIDS. According to UNAIDS an estimated number of 39.5 million people were living with HIV virus in 2006 and 4.3 million were infected in 2006. In many regions new infections are heavily concentrated in the younger generations (15-24 years of age). Access to treatment and care has greatly increased in recent years. Determining real time trends to HIV incidence and in particular the impact of prevention programmes ideally requires long studies of a large number of people. Given the practical difficulties of conducting such studies focus has been placed on young women and their infants. Children living with HIV typically acquire infection through a mother-to-child-transmission (MTCT), which occur during pregnancy, delivery or during breastfeeding. Renewed efforts are urgently required to increase access to comprehensive and integrated programs to prevent HIV infection in infants and young children, which will indicate a route to HIV-free generations.

There are two known types of HIV; HIV-1 and HIV-2 that infect humans. They belong to a group of retroviruses called Lentiviruses and a virus similar to HIV has been found in African monkeys. Retroviruses transfer their genes from a producer cell to a target cell as a genomic RNA transcript, which is reverse-transcribed after infection and integrated into the DNA genome of the target cell.

The first person with a documented HIV-infection died in 1959. In the early 1980s doctors in the US become aware, that more and more patients suffered from abnormal infections and showed signs of immune failure. The syndrome was named Acquired Immune Deficiency Syndrome (AIDS) and it was soon after discovered that HIV was the causative agent for the observed destruction of the immune system. Initially patients were offered a treatment based solely on pain relief and almost all inevitably died. In mid 1990s there were two important breakthroughs in treatment. Firstly, a new group of antiretroviral agents were discovered and secondly it became possible to measure the amount of HIV virus in blood. These two advances made it possible to treat patients with a combination of different agents and doctors were able to check, whether the treatment actually worked. The result was that the immune system of infected patients gradually became normal and patients lived longer. Today infected people in Western countries are having the same level of quality of life as those not infected and they are able to have children, although the economical and psychological consequences of having HIV are huge. The situation is, however, even more severe in developing countries, where more than 95% of those people infected with HIV/AIDS are living. Worldwide more than 25 million people have died from AIDS in the last 25 years.

Approximately 95% of the people who get infected today live in the developing countries, where expensive antiviral drugs are not available. Therefore, there is an urgent need for an effective vaccine—the only effective solution to the uncontrolled HIV pandemic. During the last few years research has brought up new knowledge on the fundamental biology of HIV-virus which is leading to new antiviral drugs and strategies for vaccine design. In spite of these substantial advances, an effective vaccine does not yet exist. Only attenuated (that is live but weakened) HIV-strains has been able to provide immunity in primate studies even though they will never reach a required safety profile suitable for mass vaccination.

The replication process for HIV-1 has an error rate of about one per 10,000 base pairs. Since the entire viral genome is just under 10,000 base pairs, it is estimated that on average one error is introduced into the HIV-1 genome at each viral replication cycle.

This high mutation rate contributes to extensive variability of the viruses inside any one person and an even wider variability across populations.

This variability has resulted in three HIV-1 variants being described, and the subspecies of virus called "clades." The distinctions are based on the structure of the envelope proteins, which are especially variable. The M (for major) variant is by far the most prevalent world wide. Within the M variant are clades A, B, C, D, E, F, G, H, I, J and K, with clades A through E representing the vast majority of infections globally. Clades A, C and D are dominant in Africa, while clade B is the most prevalent in Europe, North and South America and Southeast Asia. Clades E and C are dominant in Asia. These clades differ by as much as 35%. Another variant is clade 0, which is observed in Cameroun isolates of HIV-1. The greatest variation in structure is seen in the envelope proteins gp120 and gp41. There are two important results from the very high mutation rate of HIV-1 that have profound consequences for the epidemic. First, the high mutation rate is one of the mechanisms that allow the virus to escape from control by drug therapies. These new viruses represent resistant strains. The high mutation rate also allows the virus to escape the patient's immune system by altering the structures that are recognized by immune components. An added consequence of this extensive variability is that the virus can also escape from control by vaccines, and therefore makes it difficult to find vaccines based on envelope proteins which are effective.

Moreover, the virus produces proteins having immunosuppressive properties, allowing to escape the patient's immune system survey. Thus, cell expressing such proteins become "invisible" to the immune system.

Consequently for a vaccine, there is a need to provide proteins as antigens having lost, or substantially lost, their immunosuppressive functions, in order to generate an efficient response. This will enable the individuals once infected by the virus to allow the immune system to destroy the infected cells and prevent/cure the infection.

Prior art has already intended to provide such proteins.

For instance, the international application WO 2005/095,442 (Inventors: Renard, Mangeney & Heidmann) discloses mutations in the immunosuppressive domains of endogenous retroviruses (ERV) or onco retroviruses, such as HTLV or FeLV, ENV proteins. This document demonstrates that mutations at a specific position abolish the immunosuppressive properties of ENV proteins of ERV or onco retroviruses. However, the international application WO 2005/095, 442 never mentions or suggests that the mutations made in the immunosuppressive domain of ERV- or onco retroviruses ENV proteins can be transposable to lentiviral ENV proteins.

The international application WO 2010/022,740 discloses an extremely wide consensus sequence of a region of HIV ENV protein, described as follows:

X(1-22)-C(23)-X(24-28)-C(29)-(X30-50)

wherein the amino acid residues of the consensus sequence are selected from the groups of residues consisting of:

X(1): L, S, R, P, F, A, V, M, and I; and
X(2): Q, R, K, H, L, M, and P; and
X(3): A, T, V, H, S, R, Q, G, M, and E; and
X(4): R, K, G, E, T, S, C, M, and H; and
X(5): V, I, L, D, A, S, F, M, and G; and
X(6): L, Q, V, M, P, W, T, and I; and
X(7): A, S, T, V, L, G, F, D, M, and E; and
X(8): V, L, I, M, A, W, K, G, and E; and
X(9): E, K, G, D, A, V, M, and F; and
X(10): X; and
X(11): Y, L, F, H, C, I, T, M, and N; and
X(12): L, I, V, M, Q, P, T, Y, and A; and
X(13): K, R, Q, G, S, E, H, W, T, V, M, N, Z, Y, A, P, and C; and
X(14): D, N, G, E, Y, V, S, H, A, M, and I; and
X(15): Q, R, H, K, P, L, M, and N; and
X(16): Q, K, R, T, H, E, S, P, M, and L; and
X(17): L, F, I, R, V, P, S, M, and H, and
X(18): L, M, P, I, H, and S; and
X(19): X; and
X(20): I, L, M, V, S, F, T, D, A, R, P, and J; and
X(21): W, R, G, F, L, M, and T; and
X(22): G, D, A, R, M, and C; and
X(24): X; and
X(25): G, R, E, N, A, M, and D; and
X(26): K, R, N, E, Q, T, S, I, M, and G; and
X(27): L, H, I, T, V, F, R, Q, S, P, A, J, M, and Y; and
X(28): I, V, T, L, R, F and M; and
X(30): T, P, Y, A, N, S, I, V, R, L, M, and H; and
X(31): T, S, P, N, M and I; and
X(32): A, N, T, S, D, R, FQ, P, I, E, V, M, L, K, H, C, and B; and
X(33): V, A, L, M, G, R, and C; and
X(34): X; and
X(35): W, R, G, L, M, and P; and
X(36): N, S, D, B, K, E, R, Q, M, and G; and
X(37): S, T, A, N, D, V, I, E, Y, K, L, R, G, P, M, F, W, H, Q, B, and C; and
X(38): S, T, N, I, G, R, L, C, A, W, M and E; and
X(39): W, G, A, R, E, C, Y, V, S, M, and H; and
X(40): X; and
X(41): N, G, K, S, D, E, T, R, H, P, A, B, V, Q, Y, M, and I; and
X(42): K, R, N, D, S, T, G, E, I, V, Y, Q, P, H, A, W, M, and C, and
X(43): S, T, N, K, I, R, D, E, P, L, A, W, G, M, H, Y, F, V, and C,
X(44): L, Y, Q, F, E, H, S, V, K, M, T, I, W, N, D, R, P, A, and G; and
X(45): D, E, N, S, T, K, G, L, A, Q, H, I, Y, B, R, V, P, M, F, W, Z, and C; and
X(46): E, D, Q, Y, K, N, T, S, A, W, H, M, R, I, G, L, V, Z, F, B, and P; and
X(47): I, D, E, M, G, T, Q, S, W, L, N, Y, K, V, R, F, A, P, and H, and
X(48): W, I, T, N, D, E, L, G, S, Y, R, V, K, H, A, Q, M, and F; and
X((49): D, N, E, G, W, Q, K, H, L, B, S, I, Y, T, A, R, M, Z, and V; and
X(50): N, D, T, K, S, H, L, G, E, W, I, Q, M, R, B, Y, P, and A;

This consensus sequence contains 50 amino acids, in which the specific amino acids in position 10, 19, 24, 34 and 40 are defined as affecting the immunogenic properties of a HIV-1 envelope polypeptide, and the 45 remaining positions are randomly defined including the most common amino acids of wild-type HIV ENV proteins.

In fact, the teaching of WO 2010/022,740 is a transposition from endogenous retroviruses (ERV) or onco retroviruses to lentivirus on the basis of the teaching of WO 2005/095,442 (Inventors: Renard, Mangeney & Heidmann), but said transposition is inappropriate in the case of lentivirus, as shown by the Inventor of the present invention.

Briefly speaking, Dr Heidmann is an Inventor in WO 2005/095,442 and in the present invention. As a matter of fact, the effects of the mutations described in WO 2005/095,442 were also tested in lentivirus by the Inventor of the present invention, but no effect was observed when the mutations identified in endogenous retroviruses or onco retroviruses were transposed into ENV protein of lentivirus.

Moreover, since any amino acid can be assigned to the positions 10, 19, 24, 34 or 40 in the consensus sequence, WO 2010/022,740 teaches that such mutations can be effective using any amino acid residue. This teaching is in contradiction with the present invention, showing that the immunosuppressive properties of HIV-1 ENV protein are only affected by specific mutations that are defined not only by their position, but also by the nature of the substituted amino acid residues.

Furthermore, WO 2010/022,740 discloses experimental results for only one specific mutation within the immunosuppressive domain of HIV ENV protein, as defined by the 50 amino acids consensus sequence. The mutation, a substitution by R as the only one exemplified in the international application WO 2010/022,740, occurs at the amino acid in position 19, which again is equivalent to the position disclosed in the international application WO 2005/095,442 if one simply aligns ENV sequences (see FIG. 3 in WO 2010/022,740, which is a copy of FIG. 3 in Benit et al. 2001, *Journal of Virology*, Vol. 75, No. 23, p. 11709-11719) (Of note not only the position of the amino acid, but also the nature of the substitution (by arginine) is similar to the one described in WO 2005/095,442).

More specifically, when aligning the ENV sequences respectively of an endogenous retrovirus or onco retrovirus and a lentivirus, according to FIG. 3 of Benit et al.:

SEQ ID NO: 429

```
Endogenous or onco retrovirus: L Q N R R G L D L L F L K (E) G G L [C] A A L (WO 2005/095, 442)
```

SEQ ID NO: 430

```
Lentivirus:                    L A V E R Y L K D Q Q L L (G) I W G [C] S G K (WO 2010/022, 740)
                                                          19
```

it appears that the position 19 in lentivirus corresponds to the position in WO 2005/095,442 where a specific substitution into arginine, E-R for endogenous or onco retrovirus, results in loss of immunosuppressive activity.

The international application WO 2010/022,740 discloses that said mutated HIV ENV protein inhibits proliferation of PBMC ex vivo, but such ex vivo result has no in vivo predictive value.

However, WO 2010/022,740 never discloses or suggests that mutants are efficient in vivo, i.e. that cell expressing mutants are detected by the immune system.

Moreover, as disclosed hereafter, such mutations are not efficient in vivo. Indeed, results disclosed hereafter in the example section relative to the present invention demonstrate that said substitution G19R does not inhibit in vivo the immunosuppressive properties of the ENV protein.

As a consequence, WO 2010/022,740 raises the same technical problem as the present invention, but does not offer an appropriate technical solution. This prior art reveals the difficulties to overcome the identification of the effective mutations affecting the immunosuppressive properties of the lentiviral ENV proteins.

Thus, the provision of in vivo effective non immunosuppressive lentiviral ENV proteins remains.

SUMMARY OF THE INVENTION

One aim of the invention is to provide new mutated ENV proteins devoid of immunosuppressive properties.

Another aim of the invention is to provide a new pharmaceutical composition efficient for treating lentiviral infection.

Another aim of the invention is to provide an efficient vaccine.

The invention relates to a pharmaceutical composition comprising as active substance:

a) an isolated mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein having at least 70% identity, preferably at least 80% identity, to one sequence chosen from the group consisting of SEQ ID NO: 216, SEQ ID NO: 420 and SEQ ID NO: 421, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L, R or deleted, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is A, F, G, R or deleted, or $X_a$ is A, F, G, L, R or deleted, and $X_b$ is A, F, G, R or deleted, or b) at least one fragment of said isolated mutated human or simian lentiviral ENV protein having substantially no immunosuppressive activity, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L, R or deleted, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is A, F, G, R or deleted, or $X_a$ is A, F, G, L, R or deleted, and $X_b$ is A, F, G, R or deleted, in association with a pharmaceutically acceptable carrier, said substantial absence of immunosuppressive activity of the above mentioned mutated human or simian lentiviral ENV protein or of the above defined fragment being liable to be assessed by the fact that in an in vivo assay involving engrafted tumor cells rejection, said tumor cells being transduced either so as to express said mutated ENV protein or said fragment ("mutated ENV tumor cells"), or said tumor cells being transduced so as to express said wild type ENV protein or a fragment thereof ("wild type ENV tumor cells"), or said tumor cells being not transduced ("normal tumor cells"), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

The present application is based on the unexpected observation made by the Inventors that some specific amino acids of the immunosuppressive domain of a lentiviral ENV protein can be mutated conferring to said lentiviral ENV protein essentially no immunosuppressive properties, or no immunosuppressive properties, while retaining its antigenicity, the three-dimentional structure of the immunosuppressive domain, and its expression at the plasma membrane. Moreover, the mutated lentiviral ENV protein according to the invention does not alter the infectivity of a virus expressing it.

In the invention, the "mutated simian or human lentiviral ENV proteins" means that the ENV proteins derive from the expression of an env gene of a lentivirus of human or simian.

Lentiviruses according to the invention encompassed by the invention are HIV-1 and 2 and Simian immunodeficiency virus (SIV).

Because of the high mutation rate of HIV-1, HIV-2 and SIV viruses, the "mutated ENV protein", as defined in the invention, encompasses two meanings.

According to the first meaning, the said "mutated ENV protein" is the unnatural result of the intervention of human beings.

According to the second meaning, the mutated ENV protein also encompasses naturally occurring variants for which up to now the non immunosuppressive properties remain unknown.

This second meaning takes into consideration the natural variability of HIV and SIV variants inside a same infected individual, wherein the said "mutated ENV protein" might be non immunosuppressive but its property is undetectable because an HIV infected patient always carries many HIV variants, the majority of which is immunosuppressive.

The three following proteins correspond to wild type sequences of the ENV protein of HIV-1, HIV-2 and SIV respectively. In the invention, they are considered as reference sequences of wild type ENV proteins.

```
SEQ ID NO: 417    MRVKEKYQHLWRWGWKWGTMLLGILMICSATEK
wild type HIV-1   LWVTVYYGVPVWKEATTTLFCASDAKAYDTEVH
                  NVWATHACVPTDPNPQEVVLVNVTENFNMWKND
                  MVEQMHEDIISLWDQSLKPCVKLTPLCVSLKCT
                  DLGNATNTNSSNTNSSSGEMMMEKGEIKNCSFN
                  ISTSIRGKVQKEYAFFYKLDIIPIDNDTTSYTL
                  TSCNTSVITQACPKVSFEPIPIHYCAPAGFAIL
                  KCNNKTFNGTGPCTNVSTVQCTHGIRPVVSTQLL
                  LNGSLAEEEVVIRSANFTDNAKTIIVQLNQSVE
                  INCTRPNNNTRKSIRIQRGPGRAFVTIGKIGNMR
                  QAHCNISRAKWNATLKQIASKLREQFGNNKTII
                  FKQSSGGDPEIVTHSFNCGGEFFYCNSTQLF
                  NSTWFNSTWSTEGSNNTEGSDTITLPCRIKQFI
                  NMWQEVGKAMYAPPISGQIRCSSNITGLLLTRD
                  GGNNNNGSEIFRPGGGDMRDNWRSELYKYKV
                  VKIEPLGVAPTKAKRRVVQREKRAVGIGALFLG
                  FLGAAGSTMGARSMTLTVQARQLLSGIVQQQN
                  NLLRAIEAQQHLLQLTVWGIKQLQARILAVERYL
                  KDQQLLGIWGCSGKLICTTAVPWNASWSNKSL
                  EQIWNNMTWMEWDREINNYTSLIHSLIEESQNQ
                  QEKNEQELLELDKWASLWNWFNITNWLWYIKIF
                  IMIVGGLVGLRIVFAVLSIVNRVRQGYSPLSFQ
                  THLPTPRGPDRPEGIEEEGGERDRDRSIRLVN
                  GSLALIWDDLRSLCLFSYHRLRDLLLIVTRIVE
                  LLGRRGWEALKYWWNLLQYWSQELKNSAVSLL
                  NATAIAVAEGTDRVIEVVQGACRAIRHIPRRIRQ
                  GLERILL

SEQ ID NO: 418    MCGRNQLFVASLLASACLIYCVQYVTVFYGVPV
Wild type HIV-2   WRNASIPLFCATKNRDTWGTIQCLPDNDDYQEI
                  ALNVTEAFDAWNNTVTEQAVEDVWSLFETSIKP
                  CVKLTPLCVAMRCNSTTAKNTTSTPTTTTTANT
                  TIGENSSCIRTDNCTGLGEEEMVDCQFNMTGLE
```

-continued

```
                  RDKKKLYNETWYSKDVVCESNDTKKEKTCYMNH
                  CNTSVITESCDKHYWDTMRFRYCAPPGFALLRC
                  NDTNYSGFEPNCSKVVAATCTRMMETQTSTWFG
                  FNGTRAENRTYIYWHGRDNRTIISLNKFYNLTVH
                  CKRPGNKTVVPITLMSGLVFHSQPINRRPRQA
                  WCWFKGEWKEAMKEVKLTLAKHPRYKGTNDTEK
                  IRFIAPGERSDPEVAYMWTNCRGEFLYCNMTWFL
                  NWVENRTNQTQHNYVPCHIKQIINTWHKVGKNV
                  YLPPREGQLTCNSTVTSIIANIDGGENQTNITFS
                  AEVAELYRLELGDYKLIEVTPIGFAPTPVKRYSS
                  APVRNKRGVFVLGFLGFLTTAGAAMGAASLTL
                  SAQSRTLLAGIVQQQQQLLDVVKRQQEMLRLT
                  VWGTKNLQARVTAIEKYLKDQAQLNSWGCAFR
                  QVCHTTVPWVNDTLTPDWNNMTWQEWEQRIR
                  NLEANISESLEQAQIQQEKNMYELQKLNSWDVF
                  GNWFDLTSWIKYIQYGVYIVVGIIVLRIVIYVVQ
                  MLSRLRKGYRPVFSSPPAYFQQIHIHKDREQPA
                  REETEEDVGNSVGDNWWPWPIRYIHFLIRQLIRL
                  LNRLYNICRDLLSRSFQTLQLISQSLRRALTAVR
                  DWLRFNTAYLQYGGEWIQEAFRAFARATGETLT
                  NAWRGFWGTLGQIGRGILAVPRRIRQGAEIALL

SEQ ID NO: 419    MGCLGNQLLIAILLLSVYGIYCTLYVTVFYGVP
wild type SIV     AWRNATIPLFCATKNRDTWGTTQCLPDNGDYSE
mac239            VALNVTESFDAWNNTVTEQAIEDVWQLFETSIK
                  PCVKLSPLCITMRCNKSETDRWGLTKSITTTA
                  STTSTTASAKVDMVNETSSCIAQDNCTGLEQE
                  QMISCKFNMTGLKRDKKKEYNETWYSADLVCEQ
                  GNNTGNESRCYMNHCNTSVIQESCDKHYWDAIR
                  FRYCAPPGYALLRCNDTNYSGFMPKCSKVVVSS
                  CTRMMETQTSTWFGFNGTRAENRTYIYWHGRDN
                  RTIISLNKYYNLTMKCRRPGNKTVLPVTIMSGLV
                  FHSQPINDRPKQAWCWFGGKWKDAIKEVKQTIV
                  KHPRYTGTNNTDKINLTAPGGGDPEVTFMWTNCR
                  GEFLYCKMNWFLNWVEDRNTANQKPKEQHKRN
                  YVPCHIRQIINTWHKVGKNVYLPPREGDLTCNS
                  TVTSLIANIDWIDGNQTNITMSAEVAELYRLELG
                  DYKLVEITPIGLAPTDVKRYTTGGTSRNKRGVF
                  VLGFLGFLATAGSAMGAASLTLTAQSRTLLAGI
                  VQQQQQLLDVVKRQQELLRLTVWGTKNLQTR
                  VTAIEKYLKDQAQLNAWGCAFRQVCHTTVPW
                  PNASLTPKWNNETWQEWERKVDFLEENITALL
                  EEAQIQQEKNMYELQKLNSWDVFGNWFDLAS
                  WIKYIQYGVYIVVGVILLRIVIYIVQMLAKLRQ
                  GYRPVFSSPPSYFQQTHIQQDPALPTREGK
                  ERDGGEGGGNSSWPWQIEYIHFLIRQLIRLLTW
                  LFSNCRTLLSRVYQILQPILQRLSATLQRIREV
                  LRTELTYLQYGWSYFHEAVQAVWRSATETLAGA
                  WGDLWETLRRGGRWILAIPRRIRQGLELTLL
```

Variant in the invention encompasses SIV, HIV-1 and HIV-2 ENV proteins.

Variants of the HIV-1 mutated ENV proteins according to the invention have at least 70%, preferably at least 80%, more preferably at least 90% of identity with the wild type amino acid sequence of the HIV-1 ENV protein, and comprises the mutations as described above, and harbour no immunosuppressive activity.

Variants of the HIV-2 mutated ENV proteins according to the invention have at least 70%, preferably at least 80%, more preferably at least 90% of identity with the wild type amino acid sequence of the HIV-2 ENV protein, and comprises the mutations as described above, and harbour no immunosuppressive activity.

Variants of the SIV mutated ENV proteins according to the invention have at least 70%, preferably at least 80%, more preferably at least 90% of identity with the wild type amino acid sequence of the SIV ENV protein, and comprises the mutations as described above, and harbour no immunosuppressive activity.

The three following proteins (SEQ ID NO: 216, 420 and 421) correspond to three mutated sequences of the ENV protein of HIV-1, HIV-2 and SIV respectively. In the invention, they are considered as reference sequences of the mutated ENV proteins.

More specifically, SEQ ID NO: 216 corresponds to the SEQ ID NO: 417 in which the amino acid residue Y in position 5 ($X_a$) of the sequence A-[I/V]-E-[K/R]-$X_a$-$X_b$-X-D-Q has been substituted by R.

SEQ ID NO: 420 corresponds to the SEQ ID NO: 418 in which the amino acid residue Y in position 5 ($X_a$) of the sequence A-[I/V]-E-[K/R]-$X_a$-$X_b$-X-D-Q has been substituted by R.

SEQ ID NO: 421 corresponds to the SEQ ID NO: 419 in which the amino acid residue Y in position 5 ($X_a$) of the sequence A-[I/V]-E-[K/R]-$X_a$-$X_b$-X-D-Q has been substituted by R.

SEQ ID NO: 216 mutated HIV-1

MRVKEKYQHLWRWGWKWGTMLLGILMICSATEK
LWVTVYYGVPVWKEATTTLFCASDAKAYDTEVH
NVWATHACVPTDPNPQEVVLVNVTENFNMWKND
MVEQMHEDIISLWDQSLKPCVKLTPLCVSLKCT
DLGNATNTNSSNTNSSSGEMMMEKGEIKNCSFN
ISTSIRGKVQKEYAFFYKLDIIPIDNDTTSYTL
TSCNTSVITQACPKVSFEPIPIHYCAPAGFAI
LKCNNKTFNGTGPCTNVSTVQCTHGIRPVV
STQLLLNGSLAEEEVVIRSANFTDNAKTIIVQ
LNQSVEINCTRPNNNTRKSIRIQRGPGRAFV
TIGKIGNMRQAHCNISRAKWNATLKQIASKL
REQFGNNKTIIFKQSSGGDPEIVTHSFNCGG
EFFYCNSTQLFNSTWFNSTWSTEGSNNTEGS
DTITLPCRIKQFINMWQEVGKAMYAPPISGQIR
CSSNITGLLLTRDGGNNNNGSEIFRPGGGDM
RDNWRSELYKYKVVKIEPLGVAPTKAKRRVV
QREKRAVGIGALFLGFLGAAGSTMGARSMTL
TVQARQLLSGIVQQQNNLLRAIEAQQHLLQLT
VWGIKQLQARILAVERRLKDQQLLGIWGCSG
KLICTTAVPWNASWSNKSLEQIWNNMTWME
WDREINNYTSLIHSLIEESQNQQEKNEQELLE
LDKWASLWNWFNITNWLWYIKIFIMIVGGLVG
LRIVFAVLSIVNRVRQGYSPLSFQTHLPTPRG
PDRPEGIEEEGGERDRDRSIRLVNGSLALIW
DDLRSLCLFSYHRLRDLLLIVTRIVELLGRRG
WEALKYWWNLLQYWSQELKNSAVSLLNAT
AIAVAEGTDRVIEVVQGACRAIRHIPRRIRQG
LERILL

SEQ ID NO: 420 mutated HIV-2

MCGRNQLFVASLLASACLIYCVQYVTVFYGVPV
WRNASIPLFCATKNRDTWGTIQCLPDNDDYQEI
ALNVTEAFDAWNNTVTEQAVEDVWSLFETSIKP
CVKLTPLCVAMRCNSTTAKNTTSTPTTTTANT
TIGENSSCIRTDNCTGLGEEEMVDCQFNMTGLER
DKKKLYNETWYSKDVVCESNDTKKEKTCYMN
HCNTSVITESCDKHYWDTMRFRYCAPPGFALL
RCNDTNYSGFEPNCSKVVAATCTRMMETQTS
TWFGFNGTRAENRTYIYWHGRDNRTIISLNKFYN
LTVHCKRPGNKTVVPITLMSGLVFHSQPINRRP
RQAWCWFKGEWKEAMKEVKLTLAKHPRYKG
TNDTEKIRFIAPGERSDPEVAYMWTNCRGEFL
YCNMTWFLNWVENRTNQTQHNYVPCHIKQIINT
WHKVGKNVYLPPREGQLTCNSTVTSIIANIDGG
ENQTNITFSAEVAELYRLELGDYKLIEVTPIGFA
PTPVKRYSSAPVRNKRGVFVLGFLGFLTTAGA
AMGAASLTLSAQSRTLLAGIVQQQQLLDVVK
RQQEMLRLTVWGTKNLQARVTAIEKRLKDQAQ
LNSWGCAFRQVCHTTVPWVNDTLTPDWNNM
TWQEWEQRIRNLEANISESLEQAQIQQEKNMY
ELQKLNSWDVFGNWFDLTSWIKYIQYGVYIVVG
IIVLRIVIYVVQMLSRLRKGYRPVFSSPPAYFQ
QIHIHKDREQPAREETEEDVGNSVGDNWWPWP
IRYIHFLIRQLIRLLNRLYNICRDLLSRSFQTL
QLISQSLRRALTAVRDWLRFNTAYLQYGGEW
IQEAFRAFARATGETLTNAWRGFWGTLGQIG
RGILAVPRRIRQGAEIALL

SEQ ID NO: 421 mutated SIV mac239

MGCLGNQLLIAILLLSVYGIYCTLYVTVFYGVP
AWRNATIPLFCATKNRDTWGTTQCLPDNGDYSE
VALNVTESFDAWNNTVTEQAIEDVWQLFETSIK
PCVKLSPLCITMRCNKSETDRWGLTKSITTTAS
TTSTTASAKVDMVNETSSCIAQDNCTGLEQEQ
MISCKFNMTGLKRDKKKEYNETWYSADLVCE
QGNNTGNESRCYMNHCNTSVIQESCDKHYW
DAIRFRYCAPPGYALLRCNDTNYSGFMPKCS

-continued

KVVVSSCTRMMETQTSTWFGFNGTRAENRT
YIYWHGRDNRTIISLNKYYNLTMKCRRPGNKTV
LPVTIMSGLVFHSQPINDRPKQAWCWFGGK
WKDAIKEVKQTIVKHPRYTGTNNTDKINLTAP
GGGDPEVTFMWTNCRGEFLYCKMNWFLNW
VEDRNTANQKPKEQHKRNYVPCHIRQIINTW
HKVGKNVYLPPREGDLTCNSTVTSLIANIDWI
DGNQTNITMSAEVAELYRLELGDYKLVEITPIG
LAPTDVKRYTTGGTSRNKRGVFVLGFLGFL
ATAGSAMGAASLTLTAQSRTLLAGIVQQQQQ
LLDVVKRQQELLRLTVWGTKNLQTRVTAIEK
RLKDQAQLNAWGCAFRQVCHTTVPWPNAS
LTPKWNNETWQEWERKVDFLEENITALLEE
AQIQQEKNMYELQKLNSWDVFGNWFDLAS
WIKYIQYGVYIVVGVILLRIVIYIVQMLAKLRQ
GYRPVFSSPPSYFQQTHIQQDPALPTREGKER
DGGEGGGNSSWPWQIEYIHFLIRQLIRLLTW
LFSNCRTLLSRVYQILQPILQRLSATLQRIRE
VLRTELTYLQYGWSYFHEAVQAVWRSATE
TLAGAWGDLWETLRRGGRWILAIPRRIRQG
LELTLL

The invention also encompasses the variants of the "mutated simian or human lentiviral ENV protein", harbouring the above mentioned mutations, and conferring a lack of immunosuppressive properties to said variant.

Variants of the HIV-1 mutated ENV proteins according to the invention have at least 70%, preferably at least 80%, more preferably at least 90% of identity with the reference mutated sequence of HIV-1 ENV protein (SEQ ID NO: 216), and comprises the mutations as described above, and harbour no immunosuppressive activity.

Variants of the HIV-2 mutated ENV proteins according to the invention have at least 70%, preferably at least 80%, more preferably at least 90% of identity with the reference mutated sequence of the HIV-2 ENV protein (SEQ ID NO: 420), and comprises the mutations as described above, and harbour no immunosuppressive activity.

Variants of the SIV mutated ENV proteins according to the invention have at least 70%, preferably at least 80%, more preferably at least 90% of identity with the reference mutated sequence of the SIV ENV protein (SEQ ID NO: 421), and comprises the mutations as described above, and harbour no immunosuppressive activity.

The immunosuppressive domain (ISU) of the lentivirus according to the invention can be delimited by the sequence SEQ ID NO: 6, (SEQ ID NO: 6)
xGIVQQQxxLLxxxxxxQxxLxLxxWGxKxLQxRxxA[I/V]E[K/R]Y LxDQxxLx in which x represents any amino acid.

SEQ ID NO: 6 corresponds to the non mutated ISU domain.

In this SEQ ID NO: 6, "x" (in small letters) is to be considered independently from "X" (in capital letters) used for the first time in SEQ ID NO: 416 of the present invention.

SEQ ID NO: 6 comprises SEQ ID NO: 1.

The most advantageous immunosuppressive domains of the wild type ENV proteins according to the invention comprise the following sequences:

HIV-1 ENV protein comprises the amino acid sequence AVERYLKDQ (SEQ ID NO: 7),

HIV-2 ENV protein comprises the amino acid sequence AIEKYLKDQ (SEQ ID NO: 8), and SIV ENV protein comprises the amino acid sequence SEQ ID NO: 7 or 8.

When applying the mutations as defined above, the ISU domain looses its immunosuppressive properties.

In said SEQ ID NO: 6, the underlined amino acids are the essential amino acids.

In the invention, the ISU domain, as defined by SEQ ID NO: 6, is the minimal essential domain of the ENV protein according to the invention which harbours an immunosuppressive activity.

| Examples of wild type ISU domains: | |
|---|---|
| HIV-1 | |
| SGIVQQQNNLLRAIEAQQHLLQLTVWGIKQLQA RILAVERYLKDQQLLG | (SEQ ID NO: 366) |
| SGIVQQQNNLLRAIEAQQHLLKLTVWGIKQLQA RILAVERYLKDQQLLG | (SEQ ID NO: 367) |
| SGIVQQQNNLLRAIEAQQHLLQLTVWGIKQLQA RVLAVERYLKDQQLLG | (SEQ ID NO: 368) |
| SGIVQQQNNLLRAIEAQQHLLQLTVWGIKQLQA RILAVERYLKDQQLLG | (SEQ ID NO: 369) |
| SGIVQQQNNLLRAIEAQQQMLQLTVWGIKQLRA RVLAVERYLRDQQLLG | (SEQ ID NO: 370) |
| SGIVQQQSNLLRAIQARQHMLQLTVWGIKQLQA RVLAVERYLRDQQLLG | (SEQ ID NO: 371) |
| SIV | |
| SGIVQQQNNLLKAIEAQQHLLQLSIWGVKQLQA RLLAVERYLQDQQILG | (SEQ ID NO: 372) |
| SGIVQQQNNLLRAIEAQQHLLQLSVWGIKQLQA RVLAIERYLRDQQILG | (SEQ ID NO: 373) |
| AGIVQQQQQLLDVVKRQQELLRLTVWGTKNLQT RVSAIEKYLKDQAQLN | (SEQ ID NO: 374) |
| AGIVQQQQQLLDVVKRQQELLRLTVWGTKNLQT RVTAIEKYLKDQAQLN | (SEQ ID NO: 375) |
| HIV2 | |
| AGIVQQQQQLLDVVKRQQEMLRLTVWGTKNLQA RVTAIEKYLKDQAQLN | (SEQ ID NO: 376) |
| AGIVQQQQQLLDVVKRQQELLRLTVWGTKNLQT RVTAIEKYLKDQALLN | (SEQ ID NO: 377) |

The localization of an ISU domain can be determined in all ENV proteins of viruses as described in Benit et al. 2001, *Journal of Virology*, Vol. 75, No. 23, p. 11709-11719. In a broad meaning, the ISU domain is defined by its structure and its localization, irrespective of the fact that it possesses or not an immunosuppressive activity.

In the invention, the ISU domain refers to a specific domain in which a mutation can affect the immunosuppressive property of the ENV protein.

The immunosuppressive property of the ENV protein is preferably measured using in vivo procedures, which are representative of the physiological environment.

The immunosuppressive properties of the mutated ENV proteins according to the invention are measured according to an in vivo procedure to assay the immunosuppressive activity of a ENV protein disclosed previously [Mangeney and Heidmann *Proc Natl Acad Sci USA* 1998; 95: 14920-14925; Mangeney et al. *Proc Natl Acad Sci USA,* 2007, 104(51):20534-9].

As a physiological test, this in vivo procedure is performed using ENV proteins, or fragment thereof, which are not associated to another component or carrier proteins, such as BSA.

Briefly, a wild-type (wild type lentiviral ENV protein) or modified nucleic acid expressing the protein to be tested (mutated lentiviral ENV protein) is transfected in tumour cell lines such as MCA 205 or C18.1 cell lines by known transfection methods. The tumour cells expressing the protein to be tested are then injected especially subcutaneous (s.c.) injection to a host, generally mice. Following said injection, the establishment of tumour or, to the contrary, its rejection, is determined and the tumour area is measured. Tumor establishment was determined by palpation and tumor area ($mm^2$) was determined by measuring perpendicular tumor diameters. Immunosuppression index is defined as $i=(S_{env}-S_{none})/S_{none}$, wherein $S_{env}$ is the maximum area reached by a tumour expressing an envelope protein and $S_{none}$ is the maximum area reached by a tumour not expressing ENV protein (negative control).

According to an embodiment of the invention, the above defined ratio relative to the immunosuppressive index can be less than 0.2, and can even have a negative value (see FIGS. 2 and 3).

In vitro assay could be carried out, using high doses of synthetic peptides but they are indirect and less convincing, since the expression "immunosuppressive" is relevant when applied to animals possessing a complete immune system and not to cell lines.

An additional difficulty for the functional characterization of an ISU domain relies on the fact that the ISU carried by the retroviral ENV proteins is a highly structured proteic domain, with trimer formation within the complete ENV proteins (Caffrey M., *Biochimica et Biophysica Acta,* 1536: 116-122, 2001; Caffrey et al., *The EMBO Journal*, Vol. 17, No. 16, p. 4572-4584, 1998). Such structures are not naturally formed with ISU peptides of limited length, and this is most probably why most studies carried out with peptides provide irrelevant results and/or are dependent on specific coupling of the peptides to carrier proteins (such as BSA, e.g. Denner et al., *Current Science, AIDS* 1994, 8:1063-1072).

As mentioned above, the ENV proteins according to the invention are mutated. This mutation is made in vitro. Thus, the mutated ENV proteins according to the invention are isolated, and does not correspond to naturally occurring counterpart.

As mentioned above, the lentiviral mutated ENV proteins are substantially devoid of immunosuppressive properties. This means that the mutated ENV proteins according to the invention have no, or have reduced immunosuppressive properties with respect to the natural non mutated ENV protein from a virus of the same species. For instance, a mutated HIV ENV protein according to the invention has reduced immunosuppressive properties with respect to the wild type HIV ENV protein.

In the invention, the terms "substantially devoid of immunosuppressive properties" means that the mutated ENV proteins according to the invention have an immunosuppressive index less than about 0.2 [Mangeney and Heidmann *Proc Natl Acad Sci USA* 1998; 95: 14920-14925; Mangeney et al. *Proc Natl Acad Sci USA,* 2007, 104(51):20534-9].

In the invention, structures responsible for the antigenicity of the mutated lentiviral ENV protein are essentially preserved.

As intended herein, the expression "structures responsible for antigenicity" relates to structures of the protein which are liable to interact with components of the immune system such as antibodies or membrane receptors of immune cells, in particular T cells.

The mutation(s) within the immunosuppressive domain of the lentiviral ENV proteins is (are) sufficient to decrease the immunosuppressive activity of the mutated lentiviral ENV protein with respect to the corresponding wild type ENV. However, it might be advantageous that another amino acid be also mutated because it ensures that the structure of the mutated ENV protein is essentially conserved with respect to the corresponding wild type ENV protein.

The mutated lentiviral ENV protein has substantially retained the structure, especially the antigenic structure, e.g., immunogenic determinants, of the original determined lentiviral ENV protein, i.e. the wild type non mutated lentiviral ENV protein.

These properties can be evaluated by measuring the fusion and/or infectious properties of said mutated lentiviral ENV with respect to the same properties in the wild type non mutated lentiviral ENV protein (see example).

Generally speaking, the mutated ENV protein involved in the present invention has an average length of about 700 to about 950 amino acids.

The invention encompasses fragments of the mutated ENV protein as defined above, provided that said fragment:

- comprises at least the sequence SEQ ID NO: 2, as defined above,
- comprises at least 40 amino acids, preferably comprises at least 50 amino acids,
- is substantially devoid of immunosuppressive properties, as defined above,
- preferably, comprises the extracellular parts of the ENV protein,
- retains the structure of the ENV protein from which it derives,
- harbours the same epitopes as the corresponding fragment in the wild type ENV protein.

According to a particular embodiment, the fragment of the mutated ENV protein of the invention can comprise about 40, 50, 100, 150, 200, 250, 300, 350, 400, 450, 500, 550, 600, 650 or 700 amino acids. These values are given only in an illustrative way, as the man skilled in the art will understand that the fragment can comprise any number of amino acids comprised between 40 and 700.

Advantageously, the fragments according to the invention are such that, while retaining the antigenic structure of the full length mutated ENV protein, and thus of the wild type ENV protein, they have lost major antigenic regions that are responsible for antigenicity in another region than the region corresponding to the immunosuppressive domain.

The invention also relates to a pharmaceutical composition comprising as active substance:

a) an isolated non naturally occurring mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein having at least 70% identity, preferably at least 80% identity, to one sequence chosen from the group consisting of SEQ ID NO: 216, SEQ ID NO: 420 and SEQ ID NO: 421, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L, R or deleted, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is A, F, G, R or deleted, or $X_a$ is A, F, G, L, R or deleted, and $X_b$ is A, F, G, R or deleted, or b) at least one fragment of said isolated mutated human or simian lentiviral ENV protein having substantially no immunosuppressive activity, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L, R or deleted, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is A, F, G, R or deleted, or $X_a$ is A, F, G, L, R or deleted, and $X_b$ is A, F, G, R or deleted, in association with a pharmaceutically acceptable carrier, said substantial absence of immunosuppressive activity of the above mentioned mutated human or simian lentiviral ENV protein or of the above defined fragment being liable to be assessed by the fact that in an in vivo assay involving engrafted tumor cells rejection, said tumor cells being transduced either so as to express said mutated ENV protein or said fragment ("mutated ENV tumor cells"), or said tumor cells being transduced so as to express said wild type ENV protein or a fragment thereof ("wild type ENV tumor cells"), or said tumor cells being not transduced ("normal tumor cells"), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

In a particular embodiment, the invention relates to a pharmaceutical composition as defined above comprising as active substance:

a) an isolated mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,
X represents any amino acid,
and either
$X_a$ is A, F, G, L or R, and $X_b$ is C, D, E, H, I, K, L, M, N, P, Q, S, T, V, W or Y, or
$X_a$ is C, D, E, H, I, K, M, N, P, Q, S, T, V, W or Y, and $X_b$ is A, F, G or R, or
$X_a$ is A, F, G, L or R, and $X_b$ is A, F, G or R,
or
b) at least one fragment of said isolated mutated human or simian lentiviral ENV protein having substantially no immunosuppressive activity,
said fragment comprising at least 40 amino acids,
said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,
X represents any amino acid,
and either
$X_a$ is A, F, G, L or R, and $X_b$ is C, D, E, H, I, K, L, M, N, P, Q, S, T, V, W or Y, or
$X_a$ is C, D, E, H, I, K, M, N, P, Q, S, T, V, W or Y, and $X_b$ is A, F, G or R, or
$X_a$ is A, F, G, L or R, and $X_b$ is A, F, G or R,
in association with a pharmaceutically acceptable carrier.

The invention relates to a pharmaceutical composition as defined above comprising as active substance:
a) an isolated mutated human or simian lentiviral ENV protein having substantially no immunosuppressive activity,
said mutated human or simian lentiviral ENV protein resulting from mutation of the transmembrane (TM) subunit of a wild type human or simian lentiviral ENV protein,
said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein
X represents any amino acid,
and either
$X_a$ is A, F, G, L or R, and $X_b$ is L, I, V, M or P, or
$X_a$ is Y, I, H, C or T, and $X_b$ is A, F, G or R, or
$X_a$ is A, F, G, L or R, and $X_b$ is A, F, G or R,
or
b) at least one fragment of said isolated mutated human or simian lentiviral ENV protein having substantially no immunosuppressive activity,
said fragment comprising at least 40 amino acids,
said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein
X represents any amino acid,
and either
$X_a$ is A, F, G, L or R, and $X_b$ is L, I, V, M or P, or
$X_a$ is Y, I, H, C or T, and $X_b$ is A, F, G or R, or
$X_a$ is A, F, G, L or R, and $X_b$ is A, F, G or R,
in association with a pharmaceutically acceptable carrier.

According to a particular embodiment, the invention relates to a pharmaceutical composition as defined above comprising as active substance:
a) an isolated mutated human or simian lentiviral ENV protein having substantially no immunosuppressive activity,
said mutated human or simian lentiviral ENV protein resulting from mutation of the transmembrane (TM) subunit of a wild type human or simian lentiviral ENV protein,
said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein
X represents any amino acid,
and either
$X_a$ is A, G, or R, and $X_b$ is C, D, E, H, I, K, L, M, N, P, Q, S, T, V, W or Y, or
$X_a$ is C, D, E, H, I, K, M, N, P, Q, S, T, V, W or Y, and $X_b$ is F, G or R,
or
$X_a$ is F or L, and $X_b$ is F, G or R,
or
$X_a$ is A, G or R, and $X_b$ is A,
or
$X_a$ is A, G or R, and $X_b$ is F, G or R,
or
b) at least one fragment of said isolated mutated human or simian lentiviral ENV protein having substantially no immunosuppressive activity,
said fragment comprising at least 40 amino acids,
said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein
X represents any amino acid,
and either
$X_a$ is A, G, or R, and $X_b$ is C, D, E, H, I, K, L, M, N, P, Q, S, T, V, W or Y,
or
$X_a$ is C, D, E, H, I, K, M, N, P, Q, S, T, V, W or Y, and $X_b$ is F, G or R,
or
$X_a$ is F or L, and $X_b$ is F, G or R,
or
$X_a$ is A, G or R, and $X_b$ is A,
or
$X_a$ is A, G or R, and $X_b$ is F, G, R,
in association with a pharmaceutically acceptable carrier.

According to a particular embodiment, the invention relates to a pharmaceutical composition as defined above comprising as active substance:
a) an isolated mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, G, or R, and $X_b$ is L, I, V, M or P, or $X_a$ is Y, I, H, C or T, and $X_b$ is F, G or R, or $X_a$ is F or L, and $X_b$ is F, G or R, or $X_a$ is A, G or R, and $X_b$ is A, or $X_a$ is A, G or R, and $X_b$ is F, G or R, or b) at least one fragment of said isolated mutated human or simian lentiviral ENV protein having substantially no immunosuppressive activity, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, G, or R, and $X_b$ is L, I, V, M or P, or $X_a$ is Y, I, H, C or T, and $X_b$ is F, G or R, or $X_a$ is F or L, and $X_b$ is F, G or R, or $X_a$ is A, G or R, and $X_b$ is A, or $X_a$ is A, G or R, and $X_b$ is F, G or R, in association with a pharmaceutically acceptable carrier.

According to another particular embodiment, the invention also relates to a pharmaceutical composition as defined above comprising as active substance:

a) an isolated mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, G, or R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is F, G or R, or b) at least one fragment of said isolated mutated human or simian lentiviral ENV protein having substantially no immunosuppressive activity, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, G, or R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is F, G or R, in association with a pharmaceutically acceptable carrier.

According to another particular embodiment, the invention relates to a pharmaceutical composition as defined above, comprising as active substance:

a) an isolated mutated human or simian lentiviral ENV protein having substantially no immunosuppressive activity, said mutated human or simian lentiviral ENV protein resulting from mutation of the transmembrane (TM) subunit of a wild type human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, G, or R, and $X_b$ is L, I, V, M or P, or $X_a$ is Y, I, H, C or T, and $X_b$ is F, G or R, or b) at least one fragment of said isolated mutated human or simian lentiviral ENV protein having substantially no immunosuppressive activity, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q (SEQ ID NO: 416), wherein,

X represents any amino acid, and either $X_a$ is A, G, or R, and $X_b$ is L, I, V, M or P, or $X_a$ is Y, I, H, C or T, and $X_b$ is F, G or R, in association with a pharmaceutically acceptable carrier.

According to another particular embodiment, the invention relates to a pharmaceutical composition as defined above, wherein $X_a$ is R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is R, or $X_a$ is R, and $X_b$ is R.

According to another particular embodiment, the invention relates to a pharmaceutical composition as defined above, wherein said isolated mutated human or simian lentiviral ENV protein or said fragment of said isolated mutated human or simian lentiviral ENV protein comprises one of the following amino acid sequences:

| | |
|---|---|
| A-I-E-K-$X_a$-$X_b$-X-DQ, | (SEQ ID NO: 422) |
| A-I-E-R-$X_a$-$X_b$-X-DQ, | (SEQ ID NO: 423) |
| A-V-E-K-$X_a$-$X_b$-X-DQ, | (SEQ ID NO: 424) |
| A-V-E-R-$X_a$-$X_b$-X-DQ. | (SEQ ID NO: 425) |

In one advantageous embodiment, the invention relates to a pharmaceutical composition as defined above, wherein the resulting immunosuppressive domain, contained in the mutated lentiviral protein, comprises the amino acid sequence of the list consisting of: SEQ ID NO:9 to SEQ ID NO:37.

In the invention "SEQ ID NO: 9 to SEQ ID NO:37" encompass SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36 and SEQ ID NO: 37.

The correspondence is the following one:

| | |
|---|---|
| AVERALKD | SEQ ID NO: 9 |
| AVERFLKD | SEQ ID NO: 10 |
| AVERGLKD | SEQ ID NO: 11 |
| AVERLLKD | SEQ ID NO: 12 |
| AVERRLKD | SEQ ID NO: 13 |
| AVERYAKD | SEQ ID NO: 14 |
| AVERYFKD | SEQ ID NO: 15 |
| AVERYGKD | SEQ ID NO: 16 |
| AVERYRKD | SEQ ID NO: 17 |
| AVERAAKD | SEQ ID NO: 18 |
| AVERAFKD | SEQ ID NO: 19 |
| AVERAGKD | SEQ ID NO: 20 |
| AVERARKD | SEQ ID NO: 21 |
| AVERFAKD | SEQ ID NO: 22 |
| AVERFFKD | SEQ ID NO: 23 |
| AVERFGKD | SEQ ID NO: 24 |
| AVERFRKD | SEQ ID NO: 25 |

-continued

| | |
|---|---|
| AVERGAKD | SEQ ID NO: 26 |
| AVERGFKD | SEQ ID NO: 27 |
| AVERGGKD | SEQ ID NO: 28 |
| AVERGRKD | SEQ ID NO: 29 |
| AVERLAKD | SEQ ID NO: 30 |
| AVERLFKD | SEQ ID NO: 31 |
| AVERLGKD | SEQ ID NO: 32 |
| AVERLRKD | SEQ ID NO: 33 |
| AVERRAKD | SEQ ID NO: 34 |
| AVERRFKD | SEQ ID NO: 35 |
| AVERRGKD | SEQ ID NO: 36 |
| AVERRRKD | SEQ ID NO: 37 |

In one advantageous embodiment, the invention relates to a pharmaceutical composition as defined above, wherein the resulting immunosuppressive domain, contained in the mutated lentiviral protein, comprises the amino acid sequence of the list consisting of: SEQ ID NO: 38 to SEQ ID NO: 66. In the invention "SEQ ID NO: 38 to SEQ ID NO: 66" encompass SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65 and SEQ ID NO: 66.

The correspondence is the following one:

| | |
|---|---|
| AIEKALKD | SEQ ID NO: 38 |
| AIEKFLKD | SEQ ID NO: 39 |
| AIEKGLKD | SEQ ID NO: 40 |
| AIEKLLKD | SEQ ID NO: 41 |
| AIEKRLKD | SEQ ID NO: 42 |
| AIEKYAKD | SEQ ID NO: 43 |
| AIEKYFKD | SEQ ID NO: 44 |
| AIEKYGKD | SEQ ID NO: 45 |
| AIEKYRKD | SEQ ID NO: 46 |
| AIEKAAKD | SEQ ID NO: 47 |
| AIEKAFKD | SEQ ID NO: 48 |
| AIEKAGKD | SEQ ID NO: 49 |
| AIEKARKD | SEQ ID NO: 50 |
| AIEKFAKD | SEQ ID NO: 51 |
| AIEKFFKD | SEQ ID NO: 52 |
| AIEKFGKD | SEQ ID NO: 53 |
| AIEKFRKD | SEQ ID NO: 54 |

-continued

| | |
|---|---|
| AIEKGAKD | SEQ ID NO: 55 |
| AIEKGFKD | SEQ ID NO: 56 |
| AIEKGGKD | SEQ ID NO: 57 |
| AIEKGRKD | SEQ ID NO: 58 |
| AIEKLAKD | SEQ ID NO: 59 |
| AIEKLFKD | SEQ ID NO: 60 |
| AIEKLGKD | SEQ ID NO: 61 |
| AIEKLRKD | SEQ ID NO: 62 |
| AIEKRAKD | SEQ ID NO: 63 |
| AIEKRFKD | SEQ ID NO: 64 |
| AIEKRGKD | SEQ ID NO: 65 |
| AIEKRRKD | SEQ ID NO: 66 |

In one advantageous embodiment, the invention relates to a pharmaceutical composition as defined above, wherein the resulting immunosuppressive domain, contained in the mutated lentiviral protein, comprises the amino acid sequence of the list consisting of: SEQ ID NO: 67 to SEQ ID NO: 95.

In the invention "SEQ ID NO: 67 to SEQ ID NO:95" encompass SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94 and SEQ ID NO: 95.

The correspondence is the following one:

| | |
|---|---|
| AIERALKD | SEQ ID NO: 67 |
| AIERFLKD | SEQ ID NO: 68 |
| AIERGLKD | SEQ ID NO: 69 |
| AIERLLKD | SEQ ID NO: 70 |
| AIERRLKD | SEQ ID NO: 71 |
| AIERYAKD | SEQ ID NO: 72 |
| AIERYFKD | SEQ ID NO: 73 |
| AIERYGKD | SEQ ID NO: 74 |
| AIERYRKD | SEQ ID NO: 75 |
| AIERAAKD | SEQ ID NO: 76 |
| AIERAFKD | SEQ ID NO: 77 |
| AIERAGKD | SEQ ID NO: 78 |
| AIERARKD | SEQ ID NO: 79 |
| AIERFAKD | SEQ ID NO: 80 |
| AIERFFKD | SEQ ID NO: 81 |
| AIERFGKD | SEQ ID NO: 82 |

-continued

| | |
|---|---|
| AIERFRKD | SEQ ID NO: 83 |
| AIERGAKD | SEQ ID NO: 84 |
| AIERGFKD | SEQ ID NO: 85 |
| AIERGGKD | SEQ ID NO: 86 |
| AIERGRKD | SEQ ID NO: 87 |
| AIERLAKD | SEQ ID NO: 88 |
| AIERLFKD | SEQ ID NO: 89 |
| AIERLGKD | SEQ ID NO: 90 |
| AIERLRKD | SEQ ID NO: 91 |
| AIERRAKD | SEQ ID NO: 92 |
| AIERRFKD | SEQ ID NO: 93 |
| AIERRGKD | SEQ ID NO: 94 |
| AIERRRKD | SEQ ID NO: 95 |

As mentioned above, the previous ENV proteins having their ISU comprising the above sequence are devoid of immunosuppressive properties.

Thus, in other words, any ENV protein of human or simian lentivirus having in their ISU an amino acid sequence comprising of the sequences SEQ ID NO: 9 to 95, is devoid of immunosuppressive properties.

In other words, a simian or human lentiviral ENV protein comprising, within its ISU domain, an amino acid sequence selected from SEQ ID NO: 9 to 95 is devoid of immunosuppressive properties.

In particular, the invention relates to a pharmaceutical composition as defined above, wherein said isolated mutated human or simian lentiviral ENV protein or said fragment of said isolated mutated human or simian lentiviral ENV protein comprises one of the amino acid sequences:

SEQ ID NO: 13, SEQ ID NO: 42, SEQ ID NO: 71,

SEQ ID NO: 9 to 12,

SEQ ID NO: 14 to 41,

SEQ ID NO: 43 to 70, and

SEQ ID NO: 72 to 95.

In particular, the invention relates to a pharmaceutical composition as defined above, wherein said isolated mutated human or simian lentiviral ENV protein or said fragment of said isolated mutated human or simian lentiviral ENV protein comprises one of the amino acid sequences:

SEQ ID NO: 13, SEQ ID NO: 42, SEQ ID NO: 71,

SEQ ID NO: 9, 11, 15 to 21, 23 to 29, 31 to 38, 40, 44 to 50, 52 to 58, 60 to 67, 69, 73 to 79, 81 to 87, 89 to 95.

In the invention, the fragments of the mutated ENV proteins according to the invention comprise or consist of the following sequences: SEQ ID NO: 67 to 211.

These fragments are also devoid of immunosuppressive properties.

However, these fragments retain the structure and the antigenicity of the corresponding immunosuppressive domain that is not mutated, i.e. the wild type immunosuppressive domain.

In the invention, the fragments of the mutated ENV proteins according to the invention comprise or consist of the following sequences: SEQ ID NO: 96 to 211.

The correspondences are as follows

| | |
|---|---|
| SGIVQQQSNLLRAIQARQHMLQLTVWGIKQLQARVLAVERAL KDQQLLG | SEQ ID NO: 96 |
| SGIVQQQSNLLRAIQARQHMLQLTVWGIKQLQARVLAVERFL KDQQLLG | SEQ ID NO: 97 |
| SGIVQQQSNLLRAIQARQHMLQLTVWGIKQLQARVLAVERGL KDQQLLG | SEQ ID NO: 98 |
| SGIVQQQSNLLRAIQARQHMLQLTVWGIKQLQARVLAVERLL KDQQLLG | SEQ ID NO: 99 |
| SGIVQQQSNLLRAIQARQHMLQLTVWGIKQLQARVLAVERRL KDQQLLG | SEQ ID NO: 100 |
| SGIVQQQSNLLRAIQARQHMLQLTVWGIKQLQARVLAVERYA KDQQLLG | SEQ ID NO: 101 |
| SGIVQQQSNLLRAIQARQHMLQLTVWGIKQLQARVLAVERYF KDQQLLG | SEQ ID NO: 102 |
| SGIVQQQSNLLRAIQARQHMLQLTVWGIKQLQARVLAVERYG KDQQLLG | SEQ ID NO: 103 |
| SGIVQQQSNLLRAIQARQHMLQLTVWGIKQLQARVLAVERYR KDQQLLG | SEQ ID NO: 104 |
| SGIVQQQSNLLRAIQARQHMLQLTVWGIKQLQARVLAVERAA KDQQLLG | SEQ ID NO: 105 |
| SGIVQQQSNLLRAIQARQHMLQLTVWGIKQLQARVLAVERAF KDQQLLG | SEQ ID NO: 106 |
| SGIVQQQSNLLRAIQARQHMLQLTVWGIKQLQARVLAVERAG KDQQLLG | SEQ ID NO: 107 |
| SGIVQQQSNLLRAIQARQHMLQLTVWGIKQLQARVLAVERAR KDQQLLG | SEQ ID NO: 108 |
| SGIVQQQSNLLRAIQARQHMLQLTVWGIKQLQARVLAVERFA KDQQLLG | SEQ ID NO: 109 |
| SGIVQQQSNLLRAIQARQHMLQLTVWGIKQLQARVLAVERFF KDQQLLG | SEQ ID NO: 110 |
| SGIVQQQSNLLRAIQARQHMLQLTVWGIKQLQARVLAVERFG KDQQLLG | SEQ ID NO: 111 |
| SGIVQQQSNLLRAIQARQHMLQLTVWGIKQLQARVLAVERFR KDQQLLG | SEQ ID NO: 112 |
| SGIVQQQSNLLRAIQARQHMLQLTVWGIKQLQARVLAVERGA KDQQLLG | SEQ ID NO: 113 |
| SGIVQQQSNLLRAIQARQHMLQLTVWGIKQLQARVLAVERGF KDQQLLG | SEQ ID NO: 114 |
| SGIVQQQSNLLRAIQARQHMLQLTVWGIKQLQARVLAVERGG KDQQLLG | SEQ ID NO: 115 |
| SGIVQQQSNLLRAIQARQHMLQLTVWGIKQLQARVLAVERGR KDQQLLG | SEQ ID NO: 116 |
| SGIVQQQSNLLRAIQARQHMLQLTVWGIKQLQARVLAVERLA KDQQLLG | SEQ ID NO: 117 |
| SGIVQQQSNLLRAIQARQHMLQLTVWGIKQLQARVLAVERLF KDQQLLG | SEQ ID NO: 118 |
| SGIVQQQSNLLRAIQARQHMLQLTVWGIKQLQARVLAVERLG KDQQLLG | SEQ ID NO: 119 |
| SGIVQQQSNLLRAIQARQHMLQLTVWGIKQLQARVLAVERLR KDQQLLG | SEQ ID NO: 120 |
| SGIVQQQSNLLRAIQARQHMLQLTVWGIKQLQARVLAVERRA KDQQLLG | SEQ ID NO: 121 |

-continued

| | |
|---|---|
| SGIVQQQSNLLRAIQARQHMLQLTVWGIKQLQARVLAVERRF KDQQLLG | SEQ ID NO: 122 |
| SGIVQQQSNLLRAIQARQHMLQLTVWGIKQLQARVLAVERRG KDQQLLG | SEQ ID NO: 123 |
| SGIVQQQSNLLRAIQARQHMLQLTVWGIKQLQARVLAVERRR KDQQLLG | SEQ ID NO: 124 |
| AGIVQQQQQLLDVVKRQQEMLRLTVWGTKNLQARVTAIEKA LKDQAQLNSWGCAFRQ | SEQ ID NO: 125 |
| AGIVQQQQQLLDVVKRQQEMLRLTVWGTKNLQARVTAIEKF LKDQAQLNSWGCAFRQ | SEQ ID NO: 126 |
| AGIVQQQQQLLDVVKRQQEMLRLTVWGTKNLQARVTAIEKG LKDQAQLNSWGCAFRQ | SEQ ID NO: 127 |
| AGIVQQQQQLLDVVKRQQEMLRLTVWGTKNLQARVTAIEKL LKDQAQLNSWGCAFRQ | SEQ ID NO: 128 |
| AGIVQQQQQLLDVVKRQQEMLRLTVWGTKNLQARVTAIEKR LKDQAQLNSWGCAFRQ | SEQ ID NO: 129 |
| AGIVQQQQQLLDVVKRQQEMLRLTVWGTKNLQARVTAIEKY AKDQAQLNSWGCAFRQ | SEQ ID NO: 130 |
| AGIVQQQQQLLDVVKRQQEMLRLTVWGTKNLQARVTAIEKY FKDQAQLNSWGCAFRQ | SEQ ID NO: 131 |
| AGIVQQQQQLLDVVKRQQEMLRLTVWGTKNLQARVTAIEKY GKDQAQLNSWGCAFRQ | SEQ ID NO: 132 |
| AGIVQQQQQLLDVVKRQQEMLRLTVWGTKNLQARVTAIEKY RKDQAQLNSWGCAFRQ | SEQ ID NO: 133 |
| AGIVQQQQQLLDVVKRQQEMLRLTVWGTKNLQARVTAIEKA AKDQAQLNSWGCAFRQ | SEQ ID NO: 134 |
| AGIVQQQQQLLDVVKRQQEMLRLTVWGTKNLQARVTAIEKA FKDQAQLNSWGCAFRQ | SEQ ID NO: 135 |
| AGIVQQQQQLLDVVKRQQEMLRLTVWGTKNLQARVTAIEKA GKDQAQLNSWGCAFRQ | SEQ ID NO: 136 |
| AGIVQQQQQLLDVVKRQQEMLRLTVWGTKNLQARVTAIEKA RKDQAQLNSWGCAFRQ | SEQ ID NO: 137 |
| AGIVQQQQQLLDVVKRQQEMLRLTVWGTKNLQARVTAIEKF AKDQAQLNSWGCAFRQ | SEQ ID NO: 138 |
| AGIVQQQQQLLDVVKRQQEMLRLTVWGTKNLQARVTAIEKF FKDQAQLNSWGCAFRQ | SEQ ID NO: 139 |
| AGIVQQQQQLLDVVKRQQEMLRLTVWGTKNLQARVTAIEKF GKDQAQLNSWGCAFRQ | SEQ ID NO: 140 |
| AGIVQQQQQLLDVVKRQQEMLRLTVWGTKNLQARVTAIEKF RKDQAQLNSWGCAFRQ | SEQ ID NO: 141 |
| AGIVQQQQQLLDVVKRQQEMLRLTVWGTKNLQARVTAIEKG AKDQAQLNSWGCAFRQ | SEQ ID NO: 142 |
| AGIVQQQQQLLDVVKRQQEMLRLTVWGTKNLQARVTAIEKG FKDQAQLNSWGCAFRQ | SEQ ID NO: 143 |
| AGIVQQQQQLLDVVKRQQEMLRLTVWGTKNLQARVTAIEKG GKDQAQLNSWGCAFRQ | SEQ ID NO: 144 |
| AGIVQQQQQLLDVVKRQQEMLRLTVWGTKNLQARVTAIEKG RKDQAQLNSWGCAFRQ | SEQ ID NO: 145 |
| AGIVQQQQQLLDVVKRQQEMLRLTVWGTKNLQARVTAIEKL AKDQAQLNSWGCAFRQ | SEQ ID NO: 146 |
| AGIVQQQQQLLDVVKRQQEMLRLTVWGTKNLQARVTAIEKL FKDQAQLNSWGCAFRQ | SEQ ID NO: 147 |

-continued

| | |
|---|---|
| AGIVQQQQQLLDVVKRQQEMLRLTVWGTKNLQARVTAIEKLGKDQAQLNSWGCAFRQ | SEQ ID NO: 148 |
| AGIVQQQQQLLDVVKRQQEMLRLTVWGTKNLQARVTAIEKLRKDQAQLNSWGCAFRQ | SEQ ID NO: 149 |
| AGIVQQQQQLLDVVKRQQEMLRLTVWGTKNLQARVTAIEKRAKDQAQLNSWGCAFRQ | SEQ ID NO: 150 |
| AGIVQQQQQLLDVVKRQQEMLRLTVWGTKNLQARVTAIEKRFKDQAQLNSWGCAFRQ | SEQ ID NO: 151 |
| AGIVQQQQQLLDVVKRQQEMLRLTVWGTKNLQARVTAIEKRGKDQAQLNSWGCAFRQ | SEQ ID NO: 152 |
| AGIVQQQQQLLDVVKRQQEMLRLTVWGTKNLQARVTAIEKRRKDQAQLNSWGCAFRQ | SEQ ID NO: 153 |
| AGIVQQQQQLLDVVKRQQELLRLTVWGTKNLQARVTAIEKALQDQARLNSWGCAFRQ | SEQ ID NO: 154 |
| AGIVQQQQQLLDVVKRQQELLRLTVWGTKNLQARVTAIEKFLQDQARLNSWGCAFRQ | SEQ ID NO: 155 |
| AGIVQQQQQLLDVVKRQQELLRLTVWGTKNLQARVTAIEKGLQDQARLNSWGCAFRQ | SEQ ID NO: 156 |
| AGIVQQQQQLLDVVKRQQELLRLTVWGTKNLQARVTAIEKLLQDQARLNSWGCAFRQ | SEQ ID NO: 157 |
| AGIVQQQQQLLDVVKRQQELLRLTVWGTKNLQARVTAIEKRLQDQARLNSWGCAFRQ | SEQ ID NO: 158 |
| AGIVQQQQQLLDVVKRQQELLRLTVWGTKNLQARVTAIEKYAQDQARLNSWGCAFRQ | SEQ ID NO: 159 |
| AGIVQQQQQLLDVVKRQQELLRLTVWGTKNLQARVTAIEKYFQDQARLNSWGCAFRQ | SEQ ID NO: 160 |
| AGIVQQQQQLLDVVKRQQELLRLTVWGTKNLQARVTAIEKYGQDQARLNSWGCAFRQ | SEQ ID NO: 161 |
| AGIVQQQQQLLDVVKRQQELLRLTVWGTKNLQARVTAIEKYRQDQARLNSWGCAFRQ | SEQ ID NO: 162 |
| AGIVQQQQQLLDVVKRQQELLRLTVWGTKNLQARVTAIEKAAQDQARLNSWGCAFRQ | SEQ ID NO: 163 |
| AGIVQQQQQLLDVVKRQQELLRLTVWGTKNLQARVTAIEKAFQDQARLNSWGCAFRQ | SEQ ID NO: 164 |
| AGIVQQQQQLLDVVKRQQELLRLTVWGTKNLQARVTAIEKAGQDQARLNSWGCAFRQ | SEQ ID NO: 165 |
| AGIVQQQQQLLDVVKRQQELLRLTVWGTKNLQARVTAIEKARQDQARLNSWGCAFRQ | SEQ ID NO: 166 |
| AGIVQQQQQLLDVVKRQQELLRLTVWGTKNLQARVTAIEKFAQDQARLNSWGCAFRQ | SEQ ID NO: 167 |
| AGIVQQQQQLLDVVKRQQELLRLTVWGTKNLQARVTAIEKFFQDQARLNSWGCAFRQ | SEQ ID NO: 168 |
| AGIVQQQQQLLDVVKRQQELLRLTVWGTKNLQARVTAIEKFGQDQARLNSWGCAFRQ | SEQ ID NO: 169 |
| AGIVQQQQQLLDVVKRQQELLRLTVWGTKNLQARVTAIEKFRQDQARLNSWGCAFRQ | SEQ ID NO: 170 |
| AGIVQQQQQLLDVVKRQQELLRLTVWGTKNLQARVTAIEKGAQDQARLNSWGCAFRQ | SEQ ID NO: 171 |
| AGIVQQQQQLLDVVKRQQELLRLTVWGTKNLQARVTAIEKGFQDQARLNSWGCAFRQ | SEQ ID NO: 172 |
| AGIVQQQQQLLDVVKRQQELLRLTVWGTKNLQARVTAIEKGGQDQARLNSWGCAFRQ | SEQ ID NO: 173 |

-continued

| | |
|---|---|
| AGIVQQQQQLLDVVKRQQELLRLTVWGTKNLQARVTAIEKGRQDQARLNSWGCAFRQ | SEQ ID NO: 174 |
| AGIVQQQQQLLDVVKRQQELLRLTVWGTKNLQARVTAIEKLAQDQARLNSWGCAFRQ | SEQ ID NO: 175 |
| AGIVQQQQQLLDVVKRQQELLRLTVWGTKNLQARVTAIEKLFQDQARLNSWGCAFRQ | SEQ ID NO: 176 |
| AGIVQQQQQLLDVVKRQQELLRLTVWGTKNLQARVTAIEKLGQDQARLNSWGCAFRQ | SEQ ID NO: 177 |
| AGIVQQQQQLLDVVKRQQELLRLTVWGTKNLQARVTAIEKLRQDQARLNSWGCAFRQ | SEQ ID NO: 178 |
| AGIVQQQQQLLDVVKRQQELLRLTVWGTKNLQARVTAIEKRAQDQARLNSWGCAFRQ | SEQ ID NO: 179 |
| AGIVQQQQQLLDVVKRQQELLRLTVWGTKNLQARVTAIEKRFQDQARLNSWGCAFRQ | SEQ ID NO: 180 |
| AGIVQQQQQLLDVVKRQQELLRLTVWGTKNLQARVTAIEKRGQDQARLNSWGCAFRQ | SEQ ID NO: 181 |
| AGIVQQQQQLLDVVKRQQELLRLTVWGTKNLQARVTAIEKRRQDQARLNSWGCAFRQ | SEQ ID NO: 182 |
| AGIVQQQQQLLDVVKRQQELLRLTVWGTKNLQTRVTAIEKALKDQAQLNAWGCAFRQ | SEQ ID NO: 183 |
| AGIVQQQQQLLDVVKRQQELLRLTVWGTKNLQTRVTAIEKFLKDQAQLNAWGCAFRQ | SEQ ID NO: 184 |
| AGIVQQQQQLLDVVKRQQELLRLTVWGTKNLQTRVTAIEKGLKDQAQLNAWGCAFRQ | SEQ ID NO: 185 |
| AGIVQQQQQLLDVVKRQQELLRLTVWGTKNLQTRVTAIEKLLKDQAQLNAWGCAFRQ | SEQ ID NO: 186 |
| AGIVQQQQQLLDVVKRQQELLRLTVWGTKNLQTRVTAIEKRLKDQAQLNAWGCAFRQ | SEQ ID NO: 187 |
| AGIVQQQQQLLDVVKRQQELLRLTVWGTKNLQTRVTAIEKYAKDQAQLNAWGCAFRQ | SEQ ID NO: 188 |
| AGIVQQQQQLLDVVKRQQELLRLTVWGTKNLQTRVTAIEKYFKDQAQLNAWGCAFRQ | SEQ ID NO: 189 |
| AGIVQQQQQLLDVVKRQQELLRLTVWGTKNLQTRVTAIEKYGKDQAQLNAWGCAFRQ | SEQ ID NO: 190 |
| AGIVQQQQQLLDVVKRQQELLRLTVWGTKNLQTRVTAIEKYRKDQAQLNAWGCAFRQ | SEQ ID NO: 191 |
| AGIVQQQQQLLDVVKRQQELLRLTVWGTKNLQTRVTAIEKAAKDQAQLNAWGCAFRQ | SEQ ID NO: 192 |
| AGIVQQQQQLLDVVKRQQELLRLTVWGTKNLQTRVTAIEKAFKDQAQLNAWGCAFRQ | SEQ ID NO: 193 |
| AGIVQQQQQLLDVVKRQQELLRLTVWGTKNLQTRVTAIEKAGKDQAQLNAWGCAFRQ | SEQ ID NO: 194 |
| AGIVQQQQQLLDVVKRQQELLRLTVWGTKNLQTRVTAIEKARKDQAQLNAWGCAFRQ | SEQ ID NO: 195 |
| AGIVQQQQQLLDVVKRQQELLRLTVWGTKNLQTRVTAIEKFAKDQAQLNAWGCAFRQ | SEQ ID NO: 196 |
| AGIVQQQQQLLDVVKRQQELLRLTVWGTKNLQTRVTAIEKFFKDQAQLNAWGCAFRQ | SEQ ID NO: 197 |
| AGIVQQQQQLLDVVKRQQELLRLTVWGTKNLQTRVTAIEKFGKDQAQLNAWGCAFRQ | SEQ ID NO: 198 |
| AGIVQQQQQLLDVVKRQQELLRLTVWGTKNLQTRVTAIEKFRKDQAQLNAWGCAFRQ | SEQ ID NO: 199 |

-continued

| | |
|---|---|
| AGIVQQQQQLLDVVKRQQELLRLTVWGTKNLQTRVTAIEKG<br>AKDQAQLNAWGCAFRQ | SEQ ID<br>NO: 200 |
| AGIVQQQQQLLDVVKRQQELLRLTVWGTKNLQTRVTAIEKG<br>FKDQAQLNAWGCAFRQ | SEQ ID<br>NO: 201 |
| AGIVQQQQQLLDVVKRQQELLRLTVWGTKNLQTRVTAIEKG<br>GKDQAQLNAWGCAFRQ | SEQ ID<br>NO: 202 |
| AGIVQQQQQLLDVVKRQQELLRLTVWGTKNLQTRVTAIEKG<br>RKDQAQLNAWGCAFRQ | SEQ ID<br>NO: 203 |
| AGIVQQQQQLLDVVKRQQELLRLTVWGTKNLQTRVTAIEKL<br>AKDQAQLNAWGCAFRQ | SEQ ID<br>NO: 204 |
| AGIVQQQQQLLDVVKRQQELLRLTVWGTKNLQTRVTAIEKL<br>FKDQAQLNAWGCAFRQ | SEQ ID<br>NO: 205 |
| AGIVQQQQQLLDVVKRQQELLRLTVWGTKNLQTRVTAIEKL<br>GKDQAQLNAWGCAFRQ | SEQ ID<br>NO: 206 |
| AGIVQQQQQLLDVVKRQQELLRLTVWGTKNLQTRVTAIEKL<br>RKDQAQLNAWGCAFRQ | SEQ ID<br>NO: 207 |
| AGIVQQQQQLLDVVKRQQELLRLTVWGTKNLQTRVTAIEKR<br>AKDQAQLNAWGCAFRQ | SEQ ID<br>NO: 208 |
| AGIVQQQQQLLDVVKRQQELLRLTVWGTKNLQTRVTAIEKR<br>FKDQAQLNAWGCAFRQ | SEQ ID<br>NO: 209 |
| AGIVQQQQQLLDVVKRQQELLRLTVWGTKNLQTRVTAIEKR<br>GKDQAQLNAWGCAFRQ | SEQ ID<br>NO: 210 |
| AGIVQQQQQLLDVVKRQQELLRLTVWGTKNLQTRVTAIEKR<br>RKDQAQLNAWGCAFRQ | SEQ ID<br>NO: 211 |

In particular, the invention relates to a pharmaceutical composition as defined above, wherein said isolated mutated human or simian lentiviral ENV protein or said fragment of said isolated mutated human or simian lentiviral ENV protein comprises one of the amino acid sequences: SEQ ID NO: 96, 98, 100, 102 to 108, 110 to 116, 118 to 125, 127, 129, 131 to 137, 139 to 145, 147 to 154, 156, 158, 160 to 166, 168 to 174, 176 to 183, 185, 187, 189 to 195, 197 to 203, 205 to 211.

Advantageously, the invention relates to the pharmaceutical composition as defined above, wherein said mutated protein consists of one of the following sequences SEQ ID NO: 212 to 269

| HIV-1 LAI | |
|---|---|
| MRVKEKYQHLWRWGWKWGTMLLGILMICSATEKLWVTVY<br>YGVPVWKEATTTLFCASDAKAYDTEVHNVWATHACVPTDP<br>NPQEVVLVNVTENFNMWKNDMVEQMHEDIISLWDQSLKPC<br>VKLTPLCVSLKCTDLGNATNTNSSNTNSSSGEMMMEKGEIK<br>NCSFNISTSIRGKVQKEYAFFYKLDIIPIDNDTTSYTLTSCNTS<br>VITQACPKVSFEPIPIHYCAPAGFAILKCNNKTFNGTGPCTNVS<br>TVQCTHGIRPVVSTQLLLNGSLAEEEVVIRSANFTDNAKTIIV<br>QLNQSVEINCTRPNNNTRKSIRIQRGPGRAFVTIGKIGNMRQA<br>HCNISRAKWNATLKQIASKLREQFGNNKTIIFKQSSGGDPEIV<br>THSFNCGGEFFYCNSTQLFNSTWFNSTWSTEGSNNTEGSDTIT<br>LPCRIKQFINMWQEVGKAMYAPPISGQIRCSSNITGLLLTRDG<br>GNNNNGSEIFRPGGGDMRDNWRSELYKYKVVKIEPLGVAPT<br>KAKRRVVQREKRAVGIGALFLGFLGAAGSTMGARSMTLTV<br>QARQLLSGIVQQQNNLLRAIEAQQHLLQLTVWGIKQLQARIL<br>**AVERALKDQ**QLLGIWGCSGKLICTTAVPWNASWSNKSLEQI<br>WNNMTWMEWDREINNYTSLIHSLIEESQNQQEKNEQELLEL<br>DKWASLWNWFNITNWLWYIKIFIMIVGGLVGLRIVFAVLSIV<br>NRVRQGYSPLSFQTHLPTPRGPDRPEGIEEEGGERDRDRSIRL<br>VNGSLALIWDDLRSLCLFSYHRLRDLLLIVTRIVELLGRRGW<br>EALKYWWNLLQYWSQELKNSAVSLLNATAIAVAEGTDRVIE<br>VVQGACRAIRHIPRRIRQGLERILL | SEQ ID<br>NO:<br>212 |

-continued

| | |
|---|---|
| MRVKEKYQHLWRWGWKWGTMLLGILMICSATEKLWVTVY<br>YGVPVWKEATTTLFCASDAKAYDTEVHNVWATHACVPTDP<br>NPQEVVLVNVTENFNMWKNDMVEQMHEDIISLWDQSLKPC<br>VKLTPLCVSLKCTDLGNATNTNSSNTNSSSGEMMMEKGEIK<br>NCSFNISTSIRGKVQKEYAFFYKLDIIPIDNDTTSYTLTSCNTS<br>VITQACPKVSFEPIPIHYCAPAGFAILKCNNKTFNGTGPCTNVS<br>TVQCTHGIRPVVSTQLLLNGSLAEEEVVIRSANFTDNAKTIIV<br>QLNQSVEINCTRPNNNTRKSIRIQRGPGRAFVTIGKIGNMRQA<br>HCNISRAKWNATLKQIASKLREQFGNNKTIIFKQS SGGDPEIV<br>THSFNCGGEFFYCNSTQLFNSTWFNSTWSTEGSNNTEGSDTIT<br>LPCRIKQFINMWQEVGKAMYAPPISGQIRCSSNITGLLLTRDG<br>GNNNNGSEIFRPGGGDMRDNWRSELYKYKVVKIEPLGVAPT<br>KAKRRVVQREKRAVGIGALFLGFLGAAGSTMGARSMTLTV<br>QARQLLSGIVQQQNNLLRAIEAQQHLLQLTVWGIKQLQARIL<br>**AVERFLKDQ**QLLGIWGCSGKLICTTAVPWNASWSNKSLEQI<br>WNNMTWMEWDREINNYTSLIHSLIEESQNQQEKNEQELLEL<br>DKWASLWNWFNITNWLWYIKIFIMIVGGLVGLRIVFAVLSIV<br>NRVRQGYSPLSFQTHLPTPRGPDRPEGIEEEGGERDRDRSIRL<br>VNGSLALIWDDLRSLCLFSYHRLRDLLLIVTRIVELLGRRGW<br>EALKYWWNLLQYWSQELKNSAVSLLNATAIAVAEGTDRVIE<br>VVQGACRAIRHIPRRIRQGLERILL | SEQ ID<br>NO:<br>213 |
| MRVKEKYQHLWRWGWKWGTMLLGILMICSATEKLWVTVY<br>YGVPVWKEATTTLFCASDAKAYDTEVHNVWATHACVPTDP<br>NPQEVVLVNVTENFNMWKNDMVEQMHEDIISLWDQSLKPC<br>VKLTPLCVSLKCTDLGNATNTNSSNTNSSSGEMMMEKGEIK<br>NCSFNISTSIRGKVQKEYAFFYKLDIIPIDNDTTSYTLTSCNTS<br>VITQACPKVSFEPIPIHYCAPAGFAILKCNNKTFNGTGPCTNVS<br>TVQCTHGIRPVVSTQLLLNGSLAEEEVVIRSANFTDNAKTIIV<br>QLNQSVEINCTRPNNNTRKSIRIQRGPGRAFVTIGKIGNMRQA<br>HCNISRAKWNATLKQIASKLREQFGNNKTIIFKQSSGGDPEIV<br>THSFNCGGEFFYCNSTQLFNSTWFNSTWSTEGSNNTEGSDTIT<br>LPCRIKQFINMWQEVGKAMYAPPISGQIRCSSNITGLLLTRDG<br>GNNNNGSEIFRPGGGDMRDNWRSELYKYKVVKIEPLGVAPT<br>KAKRRVVQREKRAVGIGALFLGFLGAAGSTMGARSMTLTV<br>QARQLLSGIVQQQNNLLRAIEAQQHLLQLTVWGIKQLQARIL<br>**AVERGLKDQ**QLLGIWGCSGKLICTTAVPWNASWSNKSLEQI<br>WNNMTWMEWDREINNYTSLIHSLIEESQNQQEKNEQELLEL<br>DKWASLWNWFNITNWLWYIKIFIMIVGGLVGLRIVFAVLSIV<br>NRVRQGYSPLSFQTHLPTPRGPDRPEGIEEEGGERDRDRSIRL<br>VNGSLALIWDDLRSLCLFSYHRLRDLLLIVTRIVELLGRRGW<br>EALKYWWNLLQYWSQELKNSAVSLLNATAIAVAEGTDRVIE<br>VVQGACRAIRHIPRRIRQGLERILL | SEQ ID<br>NO:<br>214 |
| MRVKEKYQHLWRWGWKWGTMLLGILMICSATEKLWVTVY<br>YGVPVWKEATTTLFCASDAKAYDTEVHNVWATHACVPTDP<br>NPQEVVLVNVTENFNMWKNDMVEQMHEDIISLWDQSLKPC<br>VKLTPLCVSLKCTDLGNATNTNSSNTNSSSGEMMMEKGEIK<br>NCSFNISTSIRGKVQKEYAFFYKLDIIPIDNDTTSYTLTSCNTS<br>VITQACPKVSFEPIPIHYCAPAGFAILKCNNKTFNGTGPCTNVS<br>TVQCTHGIRPVVSTQLLLNGSLAEEEVVIRSANFTDNAKTIIV<br>QLNQSVEINCTRPNNNTRKSIRIQRGPGRAFVTIGKIGNMRQA<br>HCNISRAKWNATLKQIASKLREQFGNNKTIIFKQSSGGDPEIV<br>THSFNCGGEFFYCNSTQLFNSTWFNSTWSTEGSNNTEGSDTIT<br>LPCRIKQFINMWQEVGKAMYAPPISGQIRCSSNITGLLLTRDG<br>GNNNNGSEIFRPGGGDMRDNWRSELYKYKVVKIEPLGVAPT<br>KAKRRVVQREKRAVGIGALFLGFLGAAGSTMGARSMTLTV<br>QARQLLSGIVQQQNNLLRAIEAQQHLLQLTVWGIKQLQARIL<br>**AVERLLKDQ**QLLGIWGCSGKLICTTAVPWNASWSNKSLEQI<br>WNNMTWMEWDREINNYTSLIHSLIEESQNQQEKNEQELLEL<br>DKWASLWNWFNITNWLWYIKIFIMIVGGLVGLRIVFAVLSIV<br>NRVRQGYSPLSFQTHLPTPRGPDRPEGIEEEGGERDRDRSIRL<br>VNGSLALIWDDLRSLCLFSYHRLRDLLLIVTRIVELLGRRGW<br>EALKYWWNLLQYWSQELKNSAVSLLNATAIAVAEGTDRVIE<br>VVQGACRAIRHIPRRIRQGLERILL | SEQ ID<br>NO:<br>215 |
| MRVKEKYQHLWRWGWKWGTMLLGILMICSATEKLWVTVY<br>YGVPVWKEATTTLFCASDAKAYDTEVHNVWATHACVPTDP<br>NPQEVVLVNVTENFNMWKNDMVEQMHEDIISLWDQSLKPC<br>VKLTPLCVSLKCTDLGNATNTNSSNTNSSSGEMMMEKGEIK<br>NCSFNISTSIRGKVQKEYAFFYKLDIIPIDNDTTSYTLTSCNTS<br>VITQACPKVSFEPIPIHYCAPAGFAILKCNNKTFNGTGPCTNVS<br>TVQCTHGIRPVVSTQLLLNGSLAEEEVVIRSANFTDNAKTIIV<br>QLNQSVEINCTRPNNNTRKSIRIQRGPGRAFVTIGKIGNMRQA<br>HCNISRAKWNATLKQIASKLREQFGNNKTIIFKQSSGGDPEIV<br>THSFNCGGEFFYCNSTQLFNSTWFNSTWSTEGSNNTEGSDTIT<br>LPCRIKQFINMWQEVGKAMYAPPISGQIRCSSNITGLLLTRDG<br>GNNNNGSEIFRPGGGDMRDNWRSELYKYKVVKIEPLGVAPT<br>KAKRRVVQREKRAVGIGALFLGFLGAAGSTMGARSMTLTV | SEQ ID<br>NO:<br>216 |

-continued

QARQLLSGIVQQQNNLLRAIEAQQHLLQLTVWGIKQLQARIL
AVERRLKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 217

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERYAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 218

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERYFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 219

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERYGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 220

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERYRKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 221

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERAAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 222

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERAFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 223

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERAGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV

-continued

NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 224

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERARKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 225

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERFAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 226

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERFFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 227

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA

-continued

HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERFGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 228

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERFRKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 229

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERGAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 230

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERGFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

-continued

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 231
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERGGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 232
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERGRKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 233
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERLAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 234
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT

-continued

KAKRRVVQREKRAVGIGALFLGFLGAAGSTMGARSMTLTV
QARQLLSGIVQQQNNLLRAIEAQQHLLQLTVWGIKQLQARIL
AVERLFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 235
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERLGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 236
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERLRKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

MRVKEKYQHLWRWGWKWGTMLLGILMICSATEKLWVTVY SEQ
YGVPVWKEATTTLFCASDAKAYDTEVHNVWATHACVPTDP ID NO:
NPQEVVLVNVTENFNMWKNDMVEQMHEDIISLWDQSLKPC 237
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERRAKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

-continued

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERRFKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 238

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERRGKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 239

MRVKEKYQHLWRWGWKWGTMLLGILMICSATEKLWVTVY
YGVPVWKEATTTLFCASDAKAYDTEVHNVWATHACVPTDP
NPQEVVLVNVTENFNMWKNDMVEQMHEDIISLWDQSLKPC
VKLTPLCVSLKCTDLGNATNTNSSNTNSSSGEMMMEKGEIK
NCSFNISTSIRGKVQKEYAFFYKLDIIPIDNDTTSYTLTSCNTS
VITQACPKVSFEPIPIHYCAPAGFAILKCNNKTFNGTGPCTNVS
TVQCTHGIRPVVSTQLLLNGSLAEEEVVIRSANFTDNAKTIIV
QLNQSVEINCTRPNNNTRKSIRIQRGPGRAFVTIGKIGNMRQA
HCNISRAKWNATLKQIASKLREQFGNNKTIIFKQSSGGDPEIV
THSFNCGGEFFYCNSTQLFNSTWFNSTWSTEGSNNTEGSDTIT
LPCRIKQFINMWQEVGKAMYAPPISGQIRCSSNITGLLLTRDG
GNNNNGSEIFRPGGGDMRDNWRSELYKYKVVKIEPLGVAPT
KAKRRVVQREKRAVGIGALFLGFLGAAGSTMGARSMTLTV
QARQLLSGIVQQQNNLLRAIEAQQHLLQLTVWGIKQLQARIL
AVERRRKDQQLLGIWGCSGKLICTTAVPWNASWSNKSLEQI
WNNMTWMEWDREINNYTSLIHSLIEESQNQQEKNEQELLEL
DKWASLWNWFNITNWLWYIKIFIMIVGGLVGLRIVFAVLSIV
NRVRQGYSPLSFQTHLPTPRGPDRPEGIEEEGGERDRDRSIRL
VNGSLALIWDDLRSLCLFSYHRLRDLLLIVTRIVELLGRRGW
EALKYWWNLLQYWSQELKNSAVSLLNATAIAVAEGTDRVIE
VVQGACRAIRHIPRRIRQGLERILL

SEQ ID NO: 240

HIV-BH10

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERA
LKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 241

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERF
LKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 242

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERG
LKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 243

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERL
LKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 244

-continued

MRVKEKYQHLWRWGWRWGTMLLGMLMICSATEKLWVTV SEQ ID NO: 245
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERR
LKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

MRVKEKYQHLWRWGWRWGTMLLGMLMICSATEKLWVTV SEQ ID NO: 246
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERY
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

MRVKEKYQHLWRWGWRWGTMLLGMLMICSATEKLWVTV SEQ ID NO: 247
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERY
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

MRVKEKYQHLWRWGWRWGTMLLGMLMICSATEKLWVTV SEQ ID NO: 248
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERY
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

MRVKEKYQHLWRWGWRWGTMLLGMLMICSATEKLWVTV SEQ ID NO: 249
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERY
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

MRVKEKYQHLWRWGWRWGTMLLGMLMICSATEKLWVTV SEQ ID NO: 250
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERA
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

MRVKEKYQHLWRWGWRWGTMLLGMLMICSATEKLWVTV SEQ ID NO: 251
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERA
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

-continued

SEQ ID NO: 252

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERA
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 253

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERA
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 254

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERF
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 255

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERF
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

SEQ ID NO: 256

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERF
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 257

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERF
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL
WWNLLQYWSQELKNSAVSLLNATAIAVAEGTDRVIEVVQG
AYRAIRHIPRRIRQGLERILL

SEQ ID NO: 258

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERG
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

-continued

SEQ ID NO: 259

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERG
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

SEQ ID NO: 260

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERG
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 261

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERG
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 262

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL

-continued

LSGIVQQQNNLLRAIEAQQHLLQLTVWGIKQLQARILAVERL
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 263

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERL
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

SEQ ID NO: 264

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERL
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 265

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERL
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

-continued

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERR
AKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 266

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERR
FKDQQLLGIWGCSGKLICTTAVPWNASWSNKSLEQIWNNMT
WMEWDREINNYTSLIHSLIEESQNQQEKNEQELLELDKWASL
WNWFNITNWLWYIKLFIMIVGGLVGLRIVFAVLSVVNRVRQ
GYSPLSFQTHLPIPRGPDRPEGIEEEGGERDRDRSIRLVNGSLA
LIWDDLRSLCLFSYHRLRDLLLIVTRIVELLGRRGWEALKYW
WNLLQYWSQELKNSAVSLLNATAIAVAEGTDRVIEVVQGAY
RAIRHIPRRIRQGLERILL

SEQ ID NO: 267

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL
LSGIVQQQNNLLRAIEAQQHLLQLTVWGIKQLQARILAVERR
GKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 268

MRVKEKYQHLWRWGWRWGTMLLGMLMICSATEKLWVTV
YYGVPVWKEATTTLFCASDAKAYDTEVHNVWATHACVPTD
PNPQEVVLVNVTENFNMWKNDMVEQMHEDIISLWDQSLKP
CVKLTPLCVSLKCTDLKNDTNTNSSSGRMIMEKGEIKNCSFNI
STSIRGKVQKEYAFFYKLDIIPIDNDTTSYTLTSCNTSVITQAC
PKVSFEPIPIHYCAPAGFAILKCNNKTFNGTGPCTNVSTVQCT
HGIRPVVSTQLLLNGSLAEEEVVIRSANFTDNAKTIIVQLNQS
VEINCTRPNNNTRKSIRIQRGPGRAFVTIGKIGNMRQAHCNIS
RAKWNNTLKQIDSKLREQFGNNKTIIFKQSSGGDPEIVTHSFN
CGGEFFYCNSTQLFNSTWFNSTWSTKGSNNTEGSDTITLPCRI
KQIINMWQEVGKAMYAPPISGQIRCSSNITGLLLTRDGGNSN
NESEIFRPGGGDMRDNWRSELYKYKVVKIEPLGVAPTKAKR
RVVQREKRAVGIGALFLGFLGAAGSTMGAASMTLTVQARQL

-continued

LSGIVQQQNNLLRAIEAQQHLLQLTVWGIKQLQARILAVERR
RKDQQLLGIWGCSGKLICTTAVPWNASWSNKSLEQIWNNM
TWMEWDREINNYTSLIHSLIEESQNQQEKNEQELLELDKWAS
LWNWFNITNWLWYIKLFIMIVGGLVGLRIVFAVLSVVNRVR
QGYSPLSFQTHLPIPRGPDRPEGIEEEGGERDRDRSIRLVNGSL
ALIWDDLRSLCLFSYHRLRDLLLIVTRIVELLGRRGWEALKY
WWNLLQYWSQELKNSAVSLLNATAIAVAEGTDRVIEVVQG
AYRAIRHIPRRIRQGLERILL

SEQ ID NO: 269

The invention also encompasses the variants of the above sequences, harbouring the above mentioned mutations, and conferring to said variant a lack of immunosuppressive properties.

In particular, the invention relates to a pharmaceutical composition as defined above, wherein said isolated mutated human or simian lentiviral ENV protein consists of one of the amino acid sequences: SEQ ID NO: 212, 214, 216, 218 to 224, 226 to 232, 234 to 241, 243, 245, 247 to 253, 255 to 261, 263 to 269.

The invention also relates to a pharmaceutical composition as defined above, wherein said mutated protein comprises additional mutations either downstream the C-terminal end of the sequence SEQ ID NO: 416 or upstream the N-terminal end of SEQ ID NO: 416.

These additional mutations can be advantageous to maintain the three-dimensional structure of the immunosuppressive domain and of the ENV protein (see details concerning the membrane expression of the ENV protein [see FIG. 4 and example] and concerning infectivity [see FIG. 5 and example]).

In a particular embodiment, the invention relates to a pharmaceutical composition as defined above, wherein said mutated protein comprises an additional mutation in one at least of the amino acids at positions 29, 36 and 37 of SEQ ID NO: 426:

(SEQ ID NO: 426)

A[I/V]E[K/R]$X_aX_bX_1$DQ$X_2X_3$L$X_4X_5$WGC
[A/S][F/G]$X_6X_7$CV$X_8$T$X_9$VP$X_cX_{10}Z_1Z_2Z_3Z_4Z_5X_dX_e$[S/T]

wherein $X_a$ and $X_b$ are as defined above, $X_1$ to $X_{10}$ represent any amino acid, $Z_1$ to $Z_5$ represent no amino acid or any amino acid, independently from each other such that $X_c$ is A, C, D, E, F, G, H, I, K, L, M, N, P, Q, R, S, T, V, Y, or deleted, preferably A, D, or N, $X_d$ is A, C, D, E, F, G, H, I, L, M, N, P, Q, R, S, T, V, Y, W, or deleted, preferably A, G, S or Y, $X_e$ is A, C, D, E, F, G, H, I, K, L, M, N, P, Q, R, T, V, Y, W, or deleted, preferably A, D or N.

This sequence contains the following amino acid sequence A[I/V]E[K/R]$X_aX_bX_1$DQ (SEQ ID NO: 416) elongated on its C-terminal end in which additional mutations are present. It is to be noted that "$X_1$" in the above mentioned sequence SEQ ID NO: 426 has the same meaning as "X" in SEQ ID NO: 416.

In one advantageous embodiment, the invention relates to a pharmaceutical composition as defined above, said mutated protein comprising the amino acid sequences of the group consisting of SEQ ID NO: 271 to SEQ ID NO: 283.

SEQ ID NO: 271, contains the mutations Y41R, K72A:
SGIVQQQNNLLRAIEAQQHLLQLTVWGIKQLQARILAVERRLKDQQLLGI
WGCSGKLICTTAVPWNASWSNASLEQIWNNMTWMEWDREINNYTSLIHSL
IEESQNQQEKNEQEL.

SEQ ID NO: 272, contains the mutations Y41R, K72G:
SGIVQQQNNLLRAIEAQQHLLQLTVWGIKQLQARILAVERRLKDQQLLGI
WGCSGKLICTTAVPWNASWSNGSLEQIWNNMTWMEWDREINNYTSLIHSL
IEESQNQQEKNEQEL.

SEQ ID NO: 273, contains the mutations Y41R, K72S:
SGIVQQQNNLLRAIEAQQHLLQLTVWGIKQLQARILAVERRLKDQQLLGI
WGCSGKLICTTAVPWNASWSNSSLEQIWNNMTWMEWDREINNYTSLIHSL
IEESQNQQEKNEQEL.

SEQ ID NO: 274, contains the mutations Y41R, W65D:
SGIVQQQNNLLRAIEAQQHLLQLTVWGIKQLQARILAVERRLKDQQLLGI
WGCSGKLICTTAVPDNASWSNKSLEQIWNNMTWMEWDREINNYTSLIHSL
IEESQNQQEKNEQEL.

SEQ ID NO: 275, contains the mutations Y41R, W65A:
SGIVQQQNNLLRAIEAQQHLLQLTVWGIKQLQARILAVERRLKDQQLLGI
WGCSGKLICTTAVPANASWSNKSLEQIWNNMTWMEWDREINNYTSLIHSL
IEESQNQQEKNEQEL.

SEQ ID NO: 276, contains the mutations Y41R, W65N:
SGIVQQQNNLLRAIEAQQHLLQLTVWGIKQLQARILAVERRLKDQQLLGI
WGCSGKLICTTAVPNNASWSNKSLEQIWNNMTWMEWDREINNYTSLIHSL
IEESQNQQEKNEQEL.

SEQ ID NO: 277, contains the mutations Y41R, S73D:
SGIVQQQNNLLRAIEAQQHLLQLTVWGIKQLQARILAVERRLKDQQLLGI
WGCSGKLICTTAVPWNASWSNKDLEQIWNNMTWMEWDREINNYTSLIHSL
IEESQNQQEKNEQEL.

SEQ ID NO: 278, contains the mutations Y41R, S73A:
SGIVQQQNNLLRAIEAQQHLLQLTVWGIKQLQARILAVERRLKDQQLLGI
WGCSGKLICTTAVPWNASWSNKALEQIWNNMTWMEWDREINNYTSLIHSL
IEESQNQQEKNEQEL.

SEQ ID NO: 279, contains the mutations Y41R, S73N:
SGIVQQQNNLLRAIEAQQHLLQLTVWGIKQLQARILAVERRLKDQQLLGI
WGCSGKLICTTAVPWNASWSNKNLEQIWNNMTWMEWDREINNYTSLIHSL
IEESQNQQEKNEQEL.

SEQ ID NO: 280, contains the mutations Y41R, K72Y:
SGIVQQQNNLLRAIEAQQHLLQLTVWGIKQLQARILAVERRLKDQQLLGI
WGCSGKLICTTAVPWNASWSNYSLEQIWNNMTWMEWDREINNYTSLIHSL
IEESQNQQEKNEQEL.

SEQ ID NO: 281, contains the mutations R40A,
Y41R, K72A:
SGIVQQQNNLLRAIEAQQHLLQLTVWGIKQLQARILAVEARLKDQQLLGI
WGCSGKLICTTAVPWNASWSNASLEQIWNNMTWMEWDREINNYTSLIHSL
IEESQNQQEKNEQEL.

SEQ ID NO: 282, contains the mutations Y41R,
K72A, S73A:
SGIVQQQNNLLRAIEAQQHLLQLTVWGIKQLQARILAVERRLKDQQLLGI
WGCSGKLICTTAVPWNASWSNAALEQIWNNMTWMEWDREINNYTSLIHSL
IEESQNQQEKNEQEL.

SEQ ID NO: 283, contains the mutations Y41R,
W65A, K72A, S73A:
SGIVQQQNNLLRAIEAQQHLLQLTVWGIKQLQARILAVERRLKDQQLLGI
WGCSGKLICTTAVPANASWSNAALEQIWNNMTWMEWDREINNYTSLIHSL
IEESQNQQEKNEQEL.

The mutations in the above mutated peptides are indicated by the amino acid residues which are bolded and underlined.

In another aspect, the invention relates to a pharmaceutical composition as defined above, comprising an additional mutation of one at least of the amino acids $X_{11}$, $X_{12}$, $X_{13}$ and $X_{14}$ in the following sequence (containing the above defined SEQ ID NO: 416 sequence):

(SEQ ID NO: 428)
$X_{11}X_{12}X_{13}X_{14}$ILA[I/V]E[K/R]$X_aX_bX_1$DQ, wherein $X_1$ represents any amino acid, $X_a$ and $X_b$ are as defined above, $X_{11}$ is:

either deleted, or A, C, D, E, F, G, H, I, K, M, N, P, Q, R, S, T, V, Y or W, in particular A, G or R, and/or $X_{12}$ is:

either deleted, or A, C, D, E, F, G, H, I, K, L, M, N, P, R, S, T, V, Y or W, in particular A, G or R, and/or $X_{13}$ is:

either deleted, or C, D, E, F, G, H, I, K, L, M, N, P, Q, R, S, T, V, Y or W, in particular R or G, and/or $X_{14}$ is:

either deleted, or A, C, D, E, F, G, H, I, K, L, M, N, P, Q, S, T, V, Y or W, in particular A or G.

This sequence contains the following amino acid sequence A[I/V]E[K/R]$X_aX_bX_1$DQ (SEQ ID NO: 416) elongated on its N-terminal end in which additional mutations are present.

It is to be noted that "$X_1$" in SEQ ID NO: 428 has exactly the same meaning as "X" in SEQ ID NO: 416.

In another advantageous embodiment, the invention relates to a pharmaceutical composition as defined above, wherein said mutated lentiviral protein, said variant or said fragment harbour a three-dimensional structure similar to the structure of the natural non mutated lentiviral ENV protein, non mutated lentiviral ENV variant or non mutated lentiviral ENV fragment thereof.

The skilled person knows how to measure the antigenicity, by using standard proceedings.

In another advantageous embodiment, the invention relates to a pharmaceutical composition as defined above, wherein said mutated lentiviral protein, said variant or said fragment are expressed at the plasma membrane at a level substantially identical to the expression at the plasma membrane of the natural non mutated lentiviral ENV protein, non mutated lentiviral ENV variant or non mutated lentiviral ENV fragment thereof.

The membrane expression of the lentiviral ENV protein according to the invention can be measured by any techniques allowing determination of a plasma membrane protein. For instance, cells can be transfected with an expression vector allowing the expression of the mutated lentiviral ENV protein according to the invention. Cells are then incubated with an antibody recognizing specifically the extracellular part of said lentiviral mutated ENV protein. The complex (antibody/ENV protein) is detected by another antibody, and the complex can be quantified by flow cytometry (see for instance FIG. 4, and example).

If no complex is detected, the mutated ENV protein is not expressed at the plasma membrane. On the contrary, if the protein is expressed, this means that the mutated ENV protein is expressed at the plasma membrane.

In another advantageous embodiment, the invention relates to a pharmaceutical composition as defined above, wherein said mutated lentiviral ENV protein is such that a lentivirus, or a pseudotype, expressing said mutated lentiviral ENV protein, instead of the non mutated ENV protein, has a viral titer similar to the viral titer of said lentivirus, or pseudotype, expressing the non mutated lentiviral protein.

Viral titer is measured according to a commonly used protocol, and as described in the example (see FIG. 5).

In another advantageous embodiment, the invention relates to a pharmaceutical composition as defined above, wherein said mutated lentiviral ENV protein is a HIV-1 lentiviral protein consisting of the amino acid sequences SEQ ID NO: 284 to SEQ ID NO: 292.

SEQ ID NO: 284
Y41R

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERRLKDQQLLGIWGCSGKLICTTA
VPWNASWSNKSLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG
SLALIWDDLRSLCLFSYHRLRDLLLIVTRIVELLGR
RGWEALKYWWNLLQYWSQELKNSAVSLLNATAIAVA
EGTDRVIEVVQGACRAIRHIPRRIRQGLERILL

SEQ ID NO: 285
Y41R, K72A

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERRLKDQQLLGIWGCSGKLICTTA
VPWNASWSNASLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG
SLALIWDDLRSLCLFSYHRLRDLLLIVTRIVELLGR
RGWEALKYWWNLLQYWSQELKNSAVSLLNATAIAVA
EGTDRVIEVVQGACRAIRHIPRRIRQGLERILL

SEQ ID NO: 286
Y41R, K72G

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERRLKDQQLLGIWGCSGKLICTTA

-continued

VPWNASWSNGSLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG
SLALIWDDLRSLCLFSYHRLRDLLLIVTRIVELLGR
RGWEALKYWWNLLQYWSQELKNSAVSLLNATAIAVA
EGTDRVIEVVQGACRAIRHIPRRIRQGLERILL

SEQ ID NO: 287
Y41R, K72S

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERRLKDQQLLGIWGCSGKLICTTA
VPWNASWSNSSLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG
SLALIWDDLRSLCLFSYHRLRDLLLIVTRIVELLGR
RGWEALKYWWNLLQYWSQELKNSAVSLLNATAIAVA
EGTDRVIEVVQGACRAIRHIPRRIRQGLERILL

SEQ ID NO: 288
Y41G

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERGLKDQQLLGIWGCSGKLICTTA
VPWNASWSNKSLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG
SLALIWDDLRSLCLFSYHRLRDLLLIVTRIVELLGR
RGWEALKYWWNLLQYWSQELKNSAVSLLNATAIAVA
EGTDRVIEVVQGACRAIRHIPRRIRQGLERILL

SEQ ID NO: 289
Y41L

MRVKEKYQHLWRWGWKWGTMLLGILMICSATEKLWV
TVYYGVPVWKEATTTLFCASDAKAYDTEVHNVWATH
ACVPTDPNPQEVVLVNVTENFNMWKNDMVEQMHEDI
ISLWDQSLKPCVKLTPLCVSLKCTDLGNATNTNSSN
TNSSSGEMMMEKGEIKNCSFNISTSIRGKVQKEYAF
FYKLDIIPIDNDTTSYTLTSCNTSVITQACPKVSFE
PIPIHYCAPAGFAILKCNNKTFNGTGPCTNVSTVQC
THGIRPVVSTQLLLNGSLAEEEVVIRSANFTDNAKT
IIVQLNQSVEINCTRPNNNTRKSIRIQRGPGRAFVT
IGKIGNMRQAHCNISRAKWNATLKQIASKLREQFGN
NKTIIFKQSSGGDPEIVTHSFNCGGEFFYCNSTQLF
NSTWFNSTWSTEGSNNTEGSDTITLPCRIKQFINMW
QEVGKAMYAPPISGQIRCSSNITGLLLTRDGGNNNN
GSEIFRPGGGDMRDNWRSELYKYKVVKIEPLGVAPT
KAKRRVVQREKRAVGIGALFLGFLGAAGSTMGARSM
TLTVQARQLLSGIVQQQNNLLRAIEAQQHLLQLTVW
GIKQLQARILAVERLLKDQQLLGIWGCSGKLICTTA
VPWNASWSNKSLEQIWNNMTWMEWDREINNYTSLIH
SLIEESQNQQEKNEQELLELDKWASLWNWFNITNWL
WYIKIFIMIVGGLVGLRIVFAVLSIVNRVRQGYSPL
SFQTHLPTPRGPDRPEGIEEEGGERDRDRSIRLVNG

| | |
|---|---|
| | SLALIWDDLRSLCLFSYHRLRDLLLIVTRIVELLGR<br>RGWEALKYWWNLLQYWSQELKNSAVSLLNATAIAVA<br>EGTDRVIEVVQGACRAIRHIPRRIRQGLERILL |
| SEQ ID NO: 290<br>Y41A | MRVKEKYQHLWRWGWKWGTMLLGILMICSATEKLWV<br>TVYYGVPVWKEATTTLFCASDAKAYDTEVHNVWATH<br>ACVPTDPNPQEVVLVNVTENFNMWKNDMVEQMHEDI<br>ISLWDQSLKPCVKLTPLCVSLKCTDLGNATNTNSSN<br>TNSSSGEMMMEKGEIKNCSFNISTSIRGKVQKEYAF<br>FYKLDIIPIDNDTTSYTLTSCNTSVITQACPKVSFE<br>PIPIHYCAPAGFAILKCNNKTFNGTGPCTNVSTVQC<br>THGIRPVVSTQLLLNGSLAEEEVVIRSANFTDNAKT<br>IIVQLNQSVEINCTRPNNNTRKSIRIQRGPGRAFVT<br>IGKIGNMRQAHCNISRAKWNATLKQIASKLREQFGN<br>NKTIIFKQSSGGDPEIVTHSFNCGGEFFYCNSTQLF<br>NSTWFNSTWSTEGSNNTEGSDTITLPCRIKQFINMW<br>QEVGKAMYAPPISGQIRCSSNITGLLLTRDGGNNNN<br>GSEIFRPGGGDMRDNWRSELYKYKVVKIEPLGVAPT<br>KAKRRVVQREKRAVGIGALFLGFLGAAGSTMGARSM<br>TLTVQARQLLSGIVQQQNNLLRAIEAQQHLLQLTVW<br>GIKQLQARIL**AVERALKDQ**QLLGIWGCSGKLICTTA<br>VPWNASWSNKSLEQIWNNMTWMEWDREINNYTSLIH<br>SLIEESQNQQEKNEQELLELDKWASLWNWFNITNWL<br>WYIKIFIMIVGGLVGLRIVFAVLSIVNRVRQGYSPL<br>SFQTHLPTPRGPDRPEGIEEEGGERDRDRSIRLVNG<br>SLALIWDDLRSLCLFSYHRLRDLLLIVTRIVELLGR<br>RGWEALKYWWNLLQYWSQELKNSAVSLLNATAIAVA<br>EGTDRVIEVVQGACRAIRHIPRRIRQGLERILL |
| SEQ ID NO: 291<br>Y41F | MRVKEKYQHLWRWGWKWGTMLLGILMICSATEKLWV<br>TVYYGVPVWKEATTTLFCASDAKAYDTEVHNVWATH<br>ACVPTDPNPQEVVLVNVTENFNMWKNDMVEQMHEDI<br>ISLWDQSLKPCVKLTPLCVSLKCTDLGNATNTNSSN<br>TNSSSGEMMMEKGEIKNCSFNISTSIRGKVQKEYAF<br>FYKLDIIPIDNDTTSYTLTSCNTSVITQACPKVSFE<br>PIPIHYCAPAGFAILKCNNKTFNGTGPCTNVSTVQC<br>THGIRPVVSTQLLLNGSLAEEEVVIRSANFTDNAKT<br>IIVQLNQSVEINCTRPNNNTRKSIRIQRGPGRAFVT<br>IGKIGNMRQAHCNISRAKWNATLKQIASKLREQFGN<br>NKTIIFKQSSGGDPEIVTHSFNCGGEFFYCNSTQLF<br>NSTWFNSTWSTEGSNNTEGSDTITLPCRIKQFINMW<br>QEVGKAMYAPPISGQIRCSSNITGLLLTRDGGNNNN<br>GSEIFRPGGGDMRDNWRSELYKYKVVKIEPLGVAPT<br>KAKRRVVQREKRAVGIGALFLGFLGAAGSTMGARSM<br>TLTVQARQLLSGIVQQQNNLLRAIEAQQHLLQLTVW<br>GIKQLQARIL**AVERFLKDQ**QLLGIWGCSGKLICTTA<br>VPWNASWSNKSLEQIWNNMTWMEWDREINNYTSLIH<br>SLIEESQNQQEKNEQELLELDKWASLWNWFNITNWL<br>WYIKIFIMIVGGLVGLRIVFAVLSIVNRVRQGYSPL<br>SFQTHLPTPRGPDRPEGIEEEGGERDRDRSIRLVNG<br>SLALIWDDLRSLCLFSYHRLRDLLLIVTRIVELLGR<br>RGWEALKYWWNLLQYWSQELKNSAVSLLNATAIAVA<br>EGTDRVIEVVQGACRAIRHIPRRIRQGLERILL |
| SEQ ID NO: 292<br>L42R | MRVKEKYQHLWRWGWKWGTMLLGILMICSATEKLWV<br>TVYYGVPVWKEATTTLFCASDAKAYDTEVHNVWATH<br>ACVPTDPNPQEVVLVNVTENFNMWKNDMVEQMHEDI<br>ISLWDQSLKPCVKLTPLCVSLKCTDLGNATNTNSSN<br>TNSSSGEMMMEKGEIKNCSFNISTSIRGKVQKEYAF<br>FYKLDIIPIDNDTTSYTLTSCNTSVITQACPKVSFE<br>PIPIHYCAPAGFAILKCNNKTFNGTGPCTNVSTVQC<br>THGIRPVVSTQLLLNGSLAEEEVVIRSANFTDNAKT<br>IIVQLNQSVEINCTRPNNNTRKSIRIQRGPGRAFVT<br>IGKIGNMRQAHCNISRAKWNATLKQIASKLREQFGN<br>NKTIIFKQSSGGDPEIVTHSFNCGGEFFYCNSTQLF<br>NSTWFNSTWSTEGSNNTEGSDTITLPCRIKQFINMW<br>QEVGKAMYAPPISGQIRCSSNITGLLLTRDGGNNNN<br>GSEIFRPGGGDMRDNWRSELYKYKVVKIEPLGVAPT<br>KAKRRVVQREKRAVGIGALFLGFLGAAGSTMGARSM<br>TLTVQARQLLSGIVQQQNNLLRAIEAQQHLLQLTVW<br>GIKQLQARIL**AVERYRKDQ**QLLGIWGCSGKLICTTA<br>VPWNASWSNKSLEQIWNNMTWMEWDREINNYTSLIH<br>SLIEESQNQQEKNEQELLELDKWASLWNWFNITNWL<br>WYIKIFIMIVGGLVGLRIVFAVLSIVNRVRQGYSPL<br>SFQTHLPTPRGPDRPEGIEEEGGERDRDRSIRLVNG<br>SLALIWDDLRSLCLFSYHRLRDLLLIVTRIVELLGR<br>RGWEALKYWWNLLQYWSQELKNSAVSLLNATAIAVA<br>EGTDRVIEVVQGACRAIRHIPRRIRQGLERILL |
| SEQ ID NO: 293<br>SIV MM251<br>L42R | MGCLGNQLLIAILLLSVYGIYCTQYVTVFYGVPAWR<br>NATIPLFCATKNRDTWGTTQCLPDNGDYSELALNVT<br>ESFDAWENTVTEQAIEDVWQLFETSIKPCVKLSPLC<br>ITMRCNKSETDRWGLTKSSTTITTAAPTSAPVSEKI<br>DMVNETSSCIAQNNCTGLEQEQMISCKFTMTGLKRD<br>KTKEYNETWYSTDLVCEQGNSTDNESRCYMNHCNTS<br>VIQESCDKHYWDTIRFRYCAPPGYALLRCNDTNYSG<br>FMPKCSKVVVSSCTRMMETQTSTWFGFNGTRAENRT<br>YIYWHGRDNRTIISLNKYYNLTMKCRRPGNKTVLPV<br>TIMSGLVFHSQPINDRPKQAWCWFGGKWKDAIKEVK<br>QTIVKHPRYTGTNNTDKINLTAPGGGDPEVTFMWTN<br>CRGEFLYCKMNWFLNWVEDRDVTTQRPKERHRRNYV<br>PCHIRQIINTWHKVGKNVYLPPREGDLTCNSTVTSL<br>IANIDWTDGNQTSITMSAEVAELYRLELGDYKLVEI<br>TPIGLAPTDVKRYTTGGTSRNKRGVFVLGFLGFLAT<br>AGSAMGAASLTLTAQSRTLLAGIVQQQQQLLDVVKR<br>QQELLRLTVWGTKNLQTRVT**AIEKYRKDQ**AQLNAWG<br>CAFRQVCHTTVPWPNASLTPDWNNDTWQEWERKVDF<br>LEENITALLEEAQIQQEKNMYELQKLNSWDVFGNWF<br>DLASWIKYIQYGIYVVVGVILLRIVIYIVQMLAKLR<br>QGYRPVFSSPPSYFQXTHTQQDPALPTREGKEGDGG<br>EGGGNSSWPWQIEYIHFLIRQLIRLLTWLFSNCRTL<br>LSRAYQILQPILQRLSATLRRVREVLRTELTYLQYG<br>WSYFHEAVQAGWRSATETLAGAWRDLWETLRRGGRW<br>ILAIPRRIRQGLELTLL |
| SEQ ID NO: 294<br>HIV2 L42R | MEPGRNQLFVVILLTSACLVYCSQYVTVFYGIPAWK<br>NASIPLFCATKNRDTWGTIQCLPDNDDYQEIILNVT<br>EAFDAWNNTVTEQAVEDVWHLFETSIKPCVKLTPLC<br>VAMNCSRVQGNTTTPNPRTSSSTTSRPPTSAASIIN<br>ETSNCIENNTCAGLGYEEMMQCEFNMKGLEQDKKRR<br>YKDTWYLEDVVCDNTTAGTCYMRHCNTSIIKESCDK<br>HYWDAMRFRYCAPPGFALLRCNDTNYSGFEPKCTKV<br>VAASCTRMMETQTSTWFGFNGTRAENRTYIYWHGRD<br>NRTIISLNKYYNLTMRCKRPGNKTVLPITLMSGLVF<br>HSQPINTRPRQAWCRFGGRWREAMQEVKQTLVQHPR<br>YKGINDTGKINFTKPGAGSDPEVAFMWTNCRGEFLY<br>CNMTWFLNWVEDKNQTRRNYCHIKQIINTWHKVGKN<br>VYLPPREGELACESTVTSIIANIDIDKNRTHTNITF<br>SAEVAELYRLELGDYKLIEITPIGFAPTDQRRYSST<br>PVRNKRGVFVLGFLGFLATAGSAMGARSLTLSAQSR<br>TLLAGIVQQQQQLLDVVKRQQEMLRLTVWGTKNLQA<br>RVTA**IEKYRKHQ**AQLNSWGCAFRQVCHTTVPWVNDS<br>LSPDWKNMTWQEWEKQVRYLEANISQSLEEAQIQQE<br>KNMYELQKLNSWDILGNWFDLTSWVKYIQYGVHIVV<br>GIIALRIAIYVVQLLSRFRKGYRPVFSSPPGYLQQI<br>HIHKDRGQPANEGTEEDVGGDSGYDLWPWPINYVQF<br>LIHLLTRLLIGLYNICRDLLSKNSPTRRLISQSLTA<br>IRDWLRLKAAQLQYGCEWIQEAFQAFARTTRETLAG<br>AWGWLWEAARRIGRGILAVPRRIRQGAELALL |

Also, the following proteins are advantageous in the invention:

Advantageously: the mutated lentiviral proteins are

1—SEQ ID NO: 284 to 294; these mutated ENV proteins having substantially no immunosuppressive properties advantageously, 2—SEQ ID NO: 284 to SEQ ID NO: 292; these mutated ENV proteins having substantially no immunosuppressive properties and being highly expressed at the plasma membrane, more advantageously, 3—SEQ ID NO: 284 to SEQ ID NO: 291; these mutated ENV proteins having substantially no immunosuppressive properties, being highly expressed at the plasma membrane and conferring to a virus expressing them a medium or high viral titer, in particular 4—Y41F (SEQ ID NO: 291), Y41L (SEQ ID NO: 289), Y41A (SEQ ID NO: 290); these mutated ENV proteins having substantially no immunosuppressive properties, being highly expressed at the plasma membrane and confers to a virus expressing them a high viral titer. As mentioned above "confering to a virus expressing them a medium or high viral titer" means that, when the sequence of the wild type ENV protein is substituted by the sequence of the mutated ENV in the lentiviral or pseudotype retrovirus, the virus thus expresses a mutated lentiviral ENV protein, along with other wild type viral proteins (GAG, PRO, POL), said mutated ENV protein conferring to the virus the ability to enter in its target cell:

either at a level comparable or higher to the ability of the wild type virus, i.e. high ability or at a lower level compared to the ability of the wild type virus, i.e. medium or low ability.

The ability to enter in the target cell can be measured by the viral load. Viral load is a measure of the amount of target cells that can be infected by a given amount (1 mL) of virus (see FIG. 5 and example).

The invention also relates to a pharmaceutical composition comprising a nucleic acid molecule coding for a mutated lentiviral ENV protein, or variant of said protein, or fragments thereof, as defined above, in association with a pharmaceutically acceptable carrier.

In one advantageous embodiment, the invention relates to a pharmaceutical composition as defined above, wherein said nucleic acid is comprised in a vector, said vector comprising means allowing the expression of said mutated lentiviral ENV protein, or variant of said protein, or fragments thereof.

In another advantageous embodiment, the invention relates to a pharmaceutical composition as defined above, wherein said nucleic acid is comprised in a vector, said nucleic acid being placed under the control of sequences that allow the expression of said mutated lentiviral ENV protein, or variant of said protein, or fragments thereof.

In another embodiment, the invention relates to a pharmaceutical composition, as defined above, in particular as a vaccine, comprising a DNA molecule coding for said mutated lentiviral ENV protein, or variant of said protein, or fragments thereof.

DNA vaccines expressing ENV proteins can be produced as described in Bellier et al., (DNA vaccines expressing retrovirus-like particles are efficient immunogens to induce neutralizing antibodies, *Vaccine,* 27(42):5772-80, 2009).

In another advantageous embodiment, the invention relates to a pharmaceutical composition as defined above, said vector being chosen among an eukaryotic or prokaryotic expression vector, in particular an eukaryotic vector which is a viral vector, in particular a pox vector, such as a fowlpox, a canarypox, or a MVA (modified vaccinia virus Ankara) vector, an adenoviral vector, a lentiviral vector, a measles vector, a Sendai virus or a CMV (cytomegalovirus) vector.

In another advantageous embodiment, the invention relates to a pharmaceutical composition as defined above, further comprising at least one nucleotide molecule coding for a GAG and/or a PRO and/or a POL protein and/or a mutated NEF protein substantially devoid of immunosuppressive properties, of a lentivirus, preferably a lentivirus of the same origin as the mutated lentiviral ENV protein.

The advantageous mutated Nef protein contains a substitution at position 93, as described in the international application WO 2006/018289 (Inventors: Renard M., Mangeney M. and Heidmann T.) and a deletion of the N-terminus of the protein involved in its myristoylation.

GAG expression will produce virus like particles (VLPs) which are particularly advantageous for a vaccine, in particular if the ENV protein is associated with the VLP (Guerbois et al., *Virology,* 388:191-203, 2009).

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in the same vector as the one which also contains said at least one nucleic acid molecule coding for a GAG protein and/or a PRO protein and/or a POL protein and/or a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in the same vector as the one which also contains all said at least one nucleic acid molecule coding for a GAG protein and/or a PRO protein and/or a POL protein and/or a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in a vector which is different from the at least one vector containing said at least one nucleic acid molecule coding for a GAG protein and/or a PRO protein and/or a POL protein and/or a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, said nucleic acid molecule coding for a GAG protein, said nucleic acid molecule coding for a PRO protein, said nucleic acid molecule coding for a POL protein and said nucleic acid molecule coding for a mutated NEF protein substantially devoid of immunosuppressive properties, are all contained in vectors which are different from each other.

In another particular embodiment, the invention relates to a pharmaceutical composition, as defined above, comprising at least one nucleic acid molecule coding for a GAG protein and/or a mutated NEF protein, wherein said mutated NEF protein is substantially devoid of immunosuppressive properties, of a human or simian lentivirus, said lentivirus being preferably of the same origin as the mutated lentiviral ENV protein.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in the same vector as the one which also contains said at least one nucleic acid molecule coding for a GAG protein and/or a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in the same vector as the one which also contains a nucleic acid molecule coding for a GAG protein and for a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in the same vector as the one which also contains a nucleic acid molecule coding for a GAG protein and for a mutated NEF protein, wherein said mutated NEF protein is substantially devoid of immunosuppressive properties, said vector being preferably a measles vector (Guerbois et al., *Virology,* 388: 191-203, 2009) or a canary pox vector (Poulet et al., *Veterinary Record,* 153(5):141-145, 2003; Vaccari et al., *Expert Review of Vaccines, Vol.* 9, *No* 9, *pages* 997-1005, 2010).

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, is contained in a vector which is different from the at least one vector containing said at least one nucleic acid molecule coding for a GAG protein and/or a mutated NEF protein, wherein said mutated NEF protein is substantially devoid of immunosuppressive properties.

In another particular embodiment, the invention relates to a pharmaceutical composition, as defined above, wherein said nucleic acid molecule coding for a mutated human or simian lentiviral ENV protein, or a fragment of said mutated human or simian lentiviral ENV protein, said nucleic acid molecule coding for a GAG protein and said nucleic acid molecule coding for a mutated NEF protein substantially devoid of immunosuppressive properties, are all contained in vectors which are different from each other.

The invention also relates to a pharmaceutical composition according the above definition, for its use as vaccine, for the treatment or the prevention of lentiviral infection, in particular HIV-1 infection, HIV-2 infection and SIV infection.

As mentioned above the pharmaceutical composition according to the invention encompasses a vaccine, comprising as active substance, a protein as defined above, or a nucleic acid as defined above, or a vector as defined above, or a combination thereof.

In a particular embodiment, the pharmaceutical composition according to the invention encompasses a vaccine, comprising a nucleic acid coding for a GAG protein as defined above, a nucleic acid coding for a mutated ENV protein as defined above and a nucleic acid coding for a mutated NEF protein as defined above.

In a particular embodiment, the pharmaceutical composition according to the invention encompasses a vaccine as defined above, comprising a nucleic acid coding for a GAG protein as defined above, a nucleic acid coding for a mutated ENV protein as defined above and a nucleic acid coding for a mutated NEF protein as defined above, which are contained in a same vector, said same vector being preferably a canary pox vector or a measles vector, more preferably a measles vector.

In a particular embodiment, the pharmaceutical composition according to the invention encompasses a vaccine, comprising a GAG protein as defined above, a mutated ENV protein as defined above and a mutated NEF protein as defined above.

In a particular embodiment, the pharmaceutical composition according to the invention encompasses a vaccine, comprising a GAG protein as defined above, a mutated ENV protein as defined above and a mutated NEF protein as defined above which are associated to at least one adjuvant.

A comprehensive list of adjuvants that can be used in HIV vaccines is indicated in the FRANKLIN PIERCE LAW CENTER EDUCATIONAL REPORT: PATENT LANDSCAPE OF ADJUVANT FOR HIV VACCINES which is incorporated herein by reference. This list includes:

- Aluminum-based compounds such as aluminum phosphate and aluminum hydroxide.
- Immunostimulatory adjuvants like CpG, MPL and QS21 or MF59 which is a squalene oil-in water emulsions.
- Freunds incomplete adjuvant (FIA) or Freund's complete adjuvant (FCA), can also be used.
- Calcium phosphate in particular orthophosphates, metaphosphates or pyrophosphates and occasionally hydrogen or hydroxide ions.
- Muramyl dipeptide (N-Acetyl muramyl-L-alanine-D-isoglutamine, MDP) and its synthetic analogs such as muramyl tripeptide phosphatidylethanolamine MTPPTdEtn),
- Trehalose-6,6'-dimycolate,
- Saponins (Triterpenoid glycosides) like QS-21
- Stearyl Tyrosine (octadecyl ester hydrochloride salt of tyrosine) 0.107

Immunostimulatory adjuvants can include the following classes of compounds:

- Polysaccharides like:
  - Chitosan:
  - Inulin:
  - Beta-Glucans
  - Lipo-Polysaccharides or endotoxin
  - MGN-3*Actinidia eriantha* (AEPS):
  - Eldexomer:
  - CpG ODN
- Liposomes like
  - Dehydration-rehydration liposome vesicles (DRVs)
  - Cytotoxic T lymphocyte (CTL)
  - CAF01
  - Liposomes containing lipid A (LA)
- Lipid Polysine Core Peptides (LCP)
- Cytokine like GM-CSF, IL-2, IL-12 or IL-15
- Lipid A and Monophosphoryl Lipid A (MPL)
- Lipopeptide which are molecules consisting of lipid connected to a peptide. They are derived from the lipoprotein of bacterial cell wall.
- Exogenous Immunostimulatory Adjuvants which are compounds, or proteins that are not found in the human body like:
  - Proteosomes in particular Multiple Antigenic Peptides (MAP) or Exogenous Toxins Suitably, the total amount mutated lentiviral ENV protein in a single dose of the immunogenic composition is 10 g and/or the total amount of unfused polypeptide in a single dose of the immunogenic composition is 20 g. In one embodiment, the total amount of all antigens in a single dose of the immunogenic composition is 0.5-50 μg, 2-40 μg, 5-30 μg, 10μ-20 μg or around 30 μg, around 20 μg or around 10 μg.

The amount of mutated lentiviral ENV protein in a dose of the immunogenic composition is selected as an amount which induces an immune response without significant, adverse side effects in typical recipients. Such amount will vary depending upon which specific immunogen is employed and the dosing or vaccination regimen that is selected. An optimal amount for a particular immunogenic composition can be ascertained by standard studies involving observation of relevant immune responses in subjects.

Administration of the pharmaceutical composition can take the form of one or of more than one individual dose, for example as repeat doses of the same polypeptide containing composition, or in a heterologous "prime-boost" vaccination regime, including proteins and vectors. In one embodiment, the immunogenic composition of the invention is initially administered to a subject as two or three doses, wherein the doses are separated by a period of two weeks to three months, preferably one month.

Conveniently, the composition is administered to a subject (for instance as a booster) every 6-24, or 9-18 months, for instance annually. For instance, the composition is administered to a subject (for instance as a booster) at six month or 1 year intervals. Suitably in this respect, subsequent administrations of the composition to the subject boost the immune response of earlier administrations of the composition to the same subject.

In an embodiment, the immunogenic composition of the invention is used as part of a prime-boost regimen for use in the treatment or prevention of disease or infection by HIV-1 strains from one or more clades different from the one or more HIV-1 clades in the immunogenic composition. Conveniently, the composition is the priming dose. Alternatively, the composition is the boosting dose.

Suitably, two or more priming and/or boosting doses are administered. A heterologous prime-boost regime uses administration of different forms of immunogenic composition or vaccine in the prime and the boost, each of which can itself include two or more administrations. The priming composition and the boosting composition will have at least one antigen in common, although it is not necessarily an identical form of the antigen, it can be a different form of the same antigen.

Prime boost immunisations according to the invention can be homologous prime-boost regimes or heterologous prime-boost regimes. Homologous prime-boost regimes utilize the same composition for prime and boost, for instance the immunogenic composition of the invention. Heterologous prime-boost regimes can be performed with a combination of protein and DNA-based formulations. Such a strategy is considered to be effective in inducing broad immune responses. Adjuvanted protein vaccines induce mainly antibodies and CD4+ T cell immune responses, while delivery of DNA as a plasmid or a recombinant vector induces strong CD8+ T cell responses. Thus, the combination of protein and DNA vaccination can provide for a wide variety of immune responses. This is particularly relevant in the context of HIV, since neutralizing antibodies, CD4+ T cells and CD8+ T cells are thought to be important for the immune defense against HIV-1.

The invention also relates to a pharmaceutical composition according the above definition, for its use for the treatment of lentiviral infection.

The invention also relates to a method for treating patient afflicted by pathologies related to lentiviral infection, comprising the administration to a patient in a need thereof of a pharmaceutically efficient amount of the pharmaceutical composition as defined above.

The invention also relates to a method for inducing an immune response against a lentivirus that has infected an individual, said method comprising the administration to a patient in a need thereof of a pharmaceutically efficient amount of the pharmaceutical composition as defined above.

The invention also relates to a pharmaceutical composition as defined above, further comprising an antiviral agent.

The composition according to the invention can also be used in combination with the antiviral compositions listed in Table 1 below:

TABLE 1

Trade names of the different antivirals used for HIV treatment, as well as their specificity of action.

| | |
|---|---|
| Intelence ® (TMC 125/etravirine) Tibotec - | Non-nucleoside reverse transcriptase inhibitor |
| Agenerase ® (APV/amprenavir) GSK - | Protease inhibitor |
| Aptivus ® (TPV/tipranavir) Boehringer - | Protease inhibitor |
| Crixivan ® (IDV/indinavir) MSD - | Protease inhibitor |
| Invirase ® (SQV/saquinavir) Roche - | Protease inhibitor |
| Kaletra ® (LPV.r/lopinavir + ritonavir) Abbott | Protease inhibitor |
| Norvir ® (ritonavir) Abbott - | Protease inhibitor |
| Prezista ® (TMC 114/darunavir) Tibotec/Janssen-Cilag - | Protease inhibitor |
| Reyataz ® (ATZ/atazanavir) BMS - | Protease inhibitor |
| Telzir ® (APV/fosamprenavir) GSK - | Protease inhibitor |
| Viracept ® (nelfinavir) Roche - | Protease inhibitor |
| Fuzeon ® (T20/enfuvirtide) Roche - | Fusion inhibitor |
| Celsentri ® (maraviroc) Pfizer - | Entry inhibitor |
| Isentress ® (MK 0518/raltegravir) Merck - | Integrase inhibitor |
| Rescriptor ® (delavirdine) Agouron - | Non-nucleoside reverse transcriptase inhibitor |
| Sustiva ® (EFV/efavirenz) BMS - | Non-nucleoside reverse transcriptase inhibitor |
| Viramune ® (nevirapine) Boehringer - | Non-nucleoside reverse transcriptase inhibitor |
| Combivir ® (Retrovir ® + Epivir ®) GSK - | Nucleoside reverse transcriptase inhibitor |
| Emtriva ® (FTC, emtricitabine) Gilead - | Nucleoside reverse transcriptase inhibitor |
| Epivir ® (3TC, lamivudine) GSK - | Nucleoside reverse transcriptase inhibitor |
| Kivexa ® (Ziagen ® + Epivir ®) GSK - | Nucleoside reverse transcriptase inhibitor |
| Retrovir ® (AZT/zidovudine) QSK - | Nucleoside reverse transcriptase inhibitor |
| Trizivir ® (Retrovir ® + Epivir ® + Ziagen ®) GSK - | Nucleoside reverse transcriptase inhibitor |
| Videx ® (ddI/didanosine) BMS - | Nucleoside reverse transcriptase inhibitor |
| Viread ® (TDF/tenofovir) Gilead - | Nucleoside reverse transcriptase inhibitor |
| Zerit ® (d4T/stavudine) BMS - | Nucleoside reverse transcriptase inhibitor |
| Ziagen ® (ABC/abacavir) GSK - | Nucleoside reverse transcriptase inhibitor |
| Truvada ® (Emtriva ® + Viread ®) Gilead - | Nucleoside reverse transcriptase inhibitor |
| Atripla ® (Sustiva ® + Emtriva ® + Viread ®) BMS/GILEAD | Nucleoside and non-nucleoside reverse transcriptase inhibitor |

The invention also relates to a pharmaceutical composition as defined above, for simultaneous, separate or sequential use.

The invention relates to a pharmaceutical composition as defined above for its use for stimulating an immune response in a host organism.

The invention relates to a pharmaceutical composition as defined above for its use for inducing a specific immune response against the HIV ENV protein.

The invention relates to a pharmaceutical composition as defined above for its use for the prevention or the treatment of HIV infection, or pathologies related to AIDS.

The invention relates to a pharmaceutical composition as defined above, as a vaccine, for its use for inducing a specific immune response against the HIV ENV protein.

The invention relates to a pharmaceutical composition as defined above, as a vaccine, for its use for the prevention or the treatment of HIV infection, or pathologies related to AIDS.

In another aspect, the invention also relates to a method to obtain the active substance of a pharmaceutical composition, as defined above, consisting of modifying the immunosuppressive property of:

a wild-type human or simian lentiviral ENV protein, or a fragment of said wild-type human or simian lentiviral ENV protein, said fragment comprising at least 40 amino acids, said ENV protein or fragment thereof presenting a transmembrane subunit (TM) comprising an immunosuppressive domain (ISU) containing the following amino acid sequence:

A-[I/V]-E-[K/R]-X'$_a$-X'$_b$-X-D-Q, (SEQ ID NO: 427)

wherein

X represents any amino acid,

X'$_a$ is C, D, E, H, I, K, M, N, P, Q, S, T, V, W or Y, and

X'$_b$ is C, D, E, H, I, K, L, M, N, P, Q, S, T, V, W or Y, said method comprising a step of introduction of at least one mutation of X'$_a$ and/or X'$_b$, to obtain:

an isolated mutated human or simian lentiviral ENV protein having substantially no immunosuppressive activity, said mutated human or simian lentiviral ENV protein having at least 70% identity, preferably at least 80% identity, to one sequence chosen from the group consisting of SEQ ID NO: 216, SEQ ID NO: 420 and SEQ ID NO: 421, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-X$_a$-X$_b$-X-D-Q, (SEQ ID NO: 416)

wherein

X represents any amino acid, and either

X$_a$ is A, F, G, L, R or deleted, and X$_b$ is C, D, E, H, I, K, L, M, N, P, Q, S, T, V, W or Y, or X$_a$ is C, D, E, H, I, K, M, N, P, Q, S, T, V, W or Y, and X$_b$ is A, F, G, R or deleted, or X$_a$ is A, F, G, L, R or deleted, and X$_b$ is A, F, G, R or deleted, said substantial absence of immunosuppressive activity of the above mentioned mutated human or simian lentiviral ENV protein or of the above defined fragment being liable to be assessed by the fact that in an in vivo assay involving engrafted tumor cells rejection, said tumor cells being transduced either so as to express said mutated ENV protein or said fragment (mutated ENV tumor cells), or said tumor cells being transduced so as to express said wild type ENV protein or a fragment thereof (wild type ENV tumor cells), or said tumor cells being not transduced (normal tumor cells), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

The invention also relates to a method to obtain a pharmaceutical composition wherein the active substance is an isolated non naturally occurring mutated human or simian lentiviral ENV protein having substantially no immunosuppressive activity, as above defined, or fragments thereof.

The invention also relates to a method to obtain the active substance of a pharmaceutical composition, according to the above defined method, consisting of modifying the immunosuppressive property of:

a wild-type human or simian lentiviral ENV protein, or a fragment of said wild-type human or simian lentiviral ENV protein, said fragment comprising at least 40 amino acids, said ENV protein or fragment thereof presenting a transmembrane subunit (TM) comprising an immunosuppressive domain (ISU) containing the following amino acid sequence:

A-[I/V]-E-[K/R]-Y-L-X-D-Q, (SEQ ID NO: 1)

wherein

X represents any amino acid, said method comprising a step of introduction of at least one mutation of Y in position 5 and/or L in position 6, to obtain:

an isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-X$_a$-X$_b$-X-D-Q, (SEQ ID NO: 416)

wherein

X represents any amino acid, and either

X$_a$ is A, F, G, L, R or deleted, and X$_b$ is C, D, E, H, I, K, L, M, N, P, Q, S, T, V, W or Y, or X$_a$ is C, D, E, H, I, K, M, N, P, Q, S, T, V, W or Y, and X$_b$ is A, F, G, R or deleted, or X$_a$ is A, F, G, L, R or deleted, and X$_b$ is A, F, G, R or deleted.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is A, F, G or R, or $X_a$ is A, F, G, L or R, and $X_b$ is A, F, G or R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, I, V, M or P, or $X_a$ is Y, I, H, C or T, and $X_b$ is A, F, G or R, or $X_a$ is A, F, G, L or R, and $X_b$ is A, F, G or R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, G, or R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is F, G or R, or $X_a$ is F or L, and $X_b$ is F, G or R, or $X_a$ is A, G or R, and $X_b$ is A.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, G, or R, and $X_b$ is L, I, V, M or P, or $X_a$ is Y, I, H, C or T, and $X_b$ is F, G or R, or $X_a$ is F or L, and $X_b$ is F, G or R, or $X_a$ is A, G or R, and $X_b$ is A, or $X_a$ is A, G or R, and $X_b$ is F, G or R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein,

X represents any amino acid, and either $X_a$ is A, G, or R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is F, G or R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein,

X represents any amino acid, and either $X_a$ is A, G, or R, and $X_b$ is L, I, V, M or P, or $X_a$ is Y, I, H, C or T, and $X_b$ is F, G or R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein,

X represents any amino acid, and either $X_a$ is R, and $X_b$ is C, D, E, H, I, K, L, M, N, P, Q, S, T, V, W or Y, or $X_a$ is C, D, E, H, I, K, M, N, P, Q, S, T, V, W or Y, and $X_b$ is R, or $X_a$ is R, and $X_b$ is R.

The invention also relates to a method as defined above to obtain the active substance of a pharmaceutical composition, wherein said isolated mutated human or simian lentiviral ENV protein having substantially no immunosuppressive activity, or a fragment of said isolated mutated human or simian lentiviral ENV protein having substantially no immunosuppressive activity, said fragment comprising at least 40 amino acids, said mutated ENV protein and fragment thereof comprising a mutation in one at least of the amino acids at positions, 29, 36 and 37 of SEQ ID NO: 426:

(SEQ ID NO: 426)
A[I/V]E[K/R]$X_aX_bX_1$DQ$X_2X_3$L$X_4X_5$WGC[A/S]
[F/G]$X_6X_7$CV$X_8$T$X_9$VP$X_cX_{10}Z_1Z_2Z_3Z_4Z_5X_dX_e$[S/T]

wherein $X_a$ and $X_b$ are as defined in anyone of claims 1 to 15, $X_1$ to $X_{10}$ represent any amino acid, $Z_1$ to $Z_5$ represent no amino acid or any amino acid, independently from each other such that

- $X_c$ is A, C, D, E, F, G, H, I, K, L, M, N, P, Q, R, S, T, V, Y, or deleted, preferably A, D, or N,
- $X_d$ is A, C, D, E, F, G, H, I, L, M, N, P, Q, R, S, T, V, Y, W, or deleted, preferably A, G, S or Y,
- $X_e$ is A, C, D, E, F, G, H, I, K, L, M, N, P, Q, R, T, V, Y, W, or deleted, preferably A, D or N.

The present invention relates to a pharmaceutical composition comprising as active substance:

a) an isolated non naturally occurring mutated human or simian lentiviral ENV having substantially no immunosuppressive activity, said mutated human or simian lentiviral ENV resulting from mutation of the transmembrane subunit (TM) of a wild type human or simian lentiviral ENV protein, the transmembrane subunit comprising an immunosuppressive domain (ISU) comprising the following amino acid sequence:

A-[I/V]-E-[K/R]-Y-L-X-D-Q, (SEQ ID NO: 1)

said sequence encompassing

AIEKYLXDQ (SEQ ID NO: 2), AIERYLXDQ (SEQ ID NO: 3), AVEKYLXDQ (SEQ ID NO: 4) and AVERYLXDQ (SEQ ID NO: 5), wherein X represents any natural amino acid, wherein the amino acids at the positions chosen among

- the position 4 of SEQ ID NO: 1,
- the position 5 of SEQ ID NO: 1,
- the position 6 of SEQ ID NO: 1,
- the positions 4 and 5 of SEQ ID NO: 1,
- the position 4 and 6 of SEQ ID NO: 1,
- the position 5 and 6 of SEQ ID NO: 1, and
- the position 4, 5 and 6 of SEQ ID NO: 1, are:

- either deleted,
- or substituted by another amino acid such that
  - when the immunosuppressive domain comprises SEQ ID NO: 2 or 4
    - the amino acid residue at position 4 of SEQ ID NO: 1 is substituted by A, C, D, E, F, G, H, I, L, M, N, P, Q, R, S, T, V, W or Y, and/or
    - the amino acid residue at position 5 of SEQ ID NO: 1 is substituted by A, C, D, E, F, G, I, L, M, N, P, Q, R, S, T, V or W, and/or
    - the amino acid residue at position 6 of SEQ ID NO: 1 is substituted by A, C, D, E, F, G, H, I, K, M, N, P, Q, R, S, T, V, W or Y,
  - when the immunosuppressive domain comprises SEQ ID NO: 3 or 5,
    - the amino acid residue at position 4 of SEQ ID NO: 1 is substituted by A, C, D, E, F, G, H, I, K, L, M, N, P, Q, S, T, V, W or Y, and/or
    - the amino acid residue at position 5 of SEQ ID NO: 1 is substituted by A, C, D, E, F, G, I, L, M, N, P, Q, S, T, V or W, and/or
    - the amino acid residue at position 6 of SEQ ID NO: 1 is substituted by A, C, D, E, F, G, H, I, K, M, N, P, Q, R, S, T, V, W or Y, or b) a fragment of said mutated human or simian lentiviral ENV, said fragment comprising at least the immunosuppressive domain (ISU) of said wild type human or simian lentiviral ENV comprising the following amino acid sequence:

A-[I/V]-E-[K/R]-Y-L-X-D-Q, (SEQ ID NO: 1)

wherein the amino acids at the positions chosen among

- the position 4 of SEQ ID NO: 1,
- the position 5 of SEQ ID NO: 1,
- the position 6 of SEQ ID NO: 1,
- the positions 4 and 5 of SEQ ID NO: 1,
- the position 4 and 6 of SEQ ID NO: 1,
- the position 5 and 6 of SEQ ID NO: 1, and
- the position 4, 5 and 6 of SEQ ID NO: 1, are:

- either deleted,
- or substituted by another amino acid such that
  - when the immunosuppressive domain comprises SEQ ID NO: 2 or 4
    - the amino acid residue at position 4 of SEQ ID NO: 1 is substituted by A, C, D, E, F, G, H, I, L, M, N, P, Q, R, S, T, V, W or Y, and/or the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, M N, P, Q, R, S, T, V, W or Y, when the immunosuppressive domain comprises SEQ ID NO: 3 or 5, the amino acid residue at position 4 of SEQ ID NO: 1 is substituted by A, C, D, E, F, G, H, I, K, L, M, N, P, Q, S, T, W or Y, and/or the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, M N, P, Q, R, S, T, V, W or Y, said fragment having substantially no immunosuppressive properties, in association of a pharmaceutically acceptable carrier.

In one advantageous embodiment, the invention relates to a pharmaceutical composition as defined above, wherein the amino acids at the positions of the group consisting of the position 4 of SEQ ID NO: 1,
the position 5 of SEQ ID NO: 1,
the position 6 of SEQ ID NO: 1,
the positions 4 and 5 of SEQ ID NO: 1,
the position 4 and 6 of SEQ ID NO: 1,
the position 5 and 6 of SEQ ID NO: 1, and
the position 4, 5 and 6 of SEQ ID NO: 1, are substituted by another amino acid such that when the immunosuppressive domain comprises SEQ ID NO: 2 or 4 the amino acid residue at position 4 of SEQ ID NO: 1 is substituted by A, C, D, E, F, G, H, I, L, M N, P, Q, R, S, T, V, W or Y, and/or the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, N, P, Q, R, S, T, V, W or Y, when the immunosuppressive domain comprises SEQ ID NO: 3 or 5, the amino acid residue at position 4 of SEQ ID NO: 1 is substituted by A, C, D, E, F, G, H, I, K, L, M, N, P, Q, S, T, W or Y, and/or the amino acid residue at position 5 of SEQ ID NO: 1 is substituted by A, C, D, E, F, G, I, L, M, N, P, Q, S, T, V or W, and/or the amino acid residue at position 6 of SEQ ID NO: 1 is substituted by A, C, D, E, F, G, H, I, K, M, N, P, Q, R, S, T, V, W or Y.

Advantageously, the mutated lentiviral protein according to the invention, comprised in the above defined composition, comprises the amino acid sequence of the list consisting of SEQ ID NO: 407 to SEQ ID NO: 414.

The correspondence is the following one:

| | |
|---|---|
| AVEAALKD | SEQ ID NO: 407 |
| AVEEALKD | SEQ ID NO: 408 |
| AVESALKD | SEQ ID NO: 409 |
| AVETALKD | SEQ ID NO: 410 |

-continued

| | |
|---|---|
| AIEAALKD | SEQ ID NO: 411 |
| AIEEALKD | SEQ ID NO: 412 |
| AIESALKD | SEQ ID NO: 413 |
| AIETALKD | SEQ ID NO: 414 |

These proteins have been mutated at position 4 of SEQ ID NO: 1, by substitution, and the amino acid at position 5 has been substituted by A.

In one advantageous embodiment, the invention relates to a pharmaceutical composition as defined above, wherein the amino acids at the positions of the group consisting of the position 5 of SEQ ID NO: 1,
the position 6 of SEQ ID NO: 1, and
the position 5 and 6 of SEQ ID NO: 1, are substituted by another amino acid such that the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, M, N, P, Q, R, S, T, V, W or Y.

In one advantageous embodiment, the invention relates to a pharmaceutical composition as defined above, wherein said immunosuppressive domain (ISU) comprises the amino acid sequence of the group consisting of: SEQ ID NO: 4 or 5.

In one advantageous embodiment, the invention relates to a pharmaceutical composition as defined above, wherein said immunosuppressive domain (ISU) comprises the amino acid sequence SEQ ID NO: 5, and wherein the amino acid residue at position 5 of SEQ ID NO: 5 is substituted by A, F, G, L or R, or the amino acid residue at position 6 of SEQ ID NO: 5 is substituted by A, F, G or R, or the amino acid residues at position 5 and 6 of SEQ ID NO: 5 are substituted by A, F, G, or R.

This is the case when said ENV protein is the ENV protein of HIV 1 virus.

The invention also relates to a pharmaceutical composition as defined above, wherein said immunosuppressive domain (ISU) comprises the amino acid sequence SEQ ID NO: 2, and wherein the amino acid residue at position 5 of SEQ ID NO: 2 is substituted by A, F, G, L or R, or the amino acid residue at position 6 of SEQ ID NO: 2 is substituted by A, F, G or R, or the amino acid residues at position 5 and 6 of SEQ ID NO: 2 are substituted by A, F, G, or R.

The invention also relates to a pharmaceutical composition as defined above, wherein said immunosuppressive domain (ISU) comprises the amino acid sequence SEQ ID NO: 3, and wherein the amino acid residue at position 5 of SEQ ID NO: 3 is substituted by A, F, G, L or R, or the amino acid residue at position 6 of SEQ ID NO: 3 is substituted by A, F, G or R, or the amino acid residues at position 5 and 6 of SEQ ID NO: 3 are substituted by A, F, G, or R.

In one advantageous embodiment, the invention relates to a pharmaceutical composition as defined above, wherein said mutated protein further comprises the wild type amino acid sequence SEQ ID NO: 270, (SEQ ID NO: 270)
$X_1DQX_2X_3LX_4X_5WGC[A/S][F/G]X_6X_7CVX_8TX_9VPWX_{10}Z_1Z_2Z_3Z_4Z_5[N/S][E/D/N/A][S/T]$ wherein $X_1$-$X_{10}$ represents any amino acid, wherein $Z_1$ to $Z_5$ represent no amino acid or any natural amino acid, independently from each other, said mutated lentiviral protein further comprising a mutation in one at least of the amino acids at positions 23, 30 and 31 of SEQ ID NO: 270 said mutation being:

either a deletion, or a substitution such that the amino acid at position 25 of SEQ ID NO: 270 is substituted by A, C, D, E, F, G, H, I, K, L, M, N, P, Q, R, S, T, V, Y, the amino acid at position 32 of SEQ ID NO: 270 is substituted by A, C, D, E, F, G, H, I, K, L, M, P, Q, R, T, V Y, W, the amino acid at position 33 of SEQ ID NO: 270 is substituted by C, F, G, H, I, K, L, M, P, Q, R, S, T, V Y, W.

In one advantageous embodiment, the invention relates to a pharmaceutical composition comprising as active substance:

an isolated non naturally occurring mutated human or simian lentiviral ENV having substantially no immunosuppressive activity, said mutated human or simian lentiviral ENV resulting from mutation of a wild type human or simian lentiviral ENV protein, said wild type human or simian lentiviral ENV protein comprising the following amino acid sequence:

(SEQ ID NO: 415)
$A[I/V]E[K/R]YLX_1DQX_2X_3LX_4X_5WGC[A/S][F/G]X_6X_7CVX_8TX_9VPWX_{10}Z_1Z_2Z_3Z_4Z_5[N/S][E/D/N/A][S/T]$, wherein $X_1$-$X_{10}$ represents any amino acid, wherein $Z_1$ to $Z_5$ represent no amino acid or any natural amino acid, independently from each other, wherein the amino acids at the positions chosen among the position 4 of SEQ ID NO: 1, the position 5 of SEQ ID NO: 1, the position 6 of SEQ ID NO: 1, the positions 4 and 5 of SEQ ID NO: 1, the position 4 and 6 of SEQ ID NO: 1, the position 5 and 6 of SEQ ID NO: 1, and the position 4, 5 and 6 of SEQ ID NO: 1, are:

either deleted, or substituted by another amino acid such that the amino acid residue at position 4 of SEQ ID NO: 1 is substituted by A, C, D, E, F, G, H, I, L, M N, P, Q, S, T, V, W or Y, and/or the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, N, P, Q, R, S, T, V, W or Y, and further wherein one at least of the amino acids at positions 29, 36 and 37 of the amino acid sequence SEQ ID NO: 415 are mutated, by either a deletion, or a substitution such that the amino acid at position 29 of SEQ ID NO: 415 is substituted by A, C, D, E, F, G, H I, K, L, M, N, P, Q, R, S, T, V Y, the amino acid at position 36 of SEQ ID NO: 415 is substituted by A, C, D, E, F, G, H, I, K, L, M, P, Q, R, T, V Y, W, the amino acid at position 37 of SEQ ID NO: 415 is substituted by C, F, G, H, I, K, L, M, P, Q, R, S, T, V Y, W In another aspect, the invention relates to a pharmaceutical composition as defined above, further comprising a mutation at the position $X_4$ (SEQ ID NO: 270)
$X_1DQX_2X_3LX_4X_5WGC[A/S][F/G]X_6X_7CVX_8TX_9VPWX_{10}Z_1Z_2Z_3Z_4Z_5[N/S][E/D/N/A][S/T]$ wherein X—$X_3$ and $X_5$-$X_{10}$ represents any amino acid, $Z_1$ to $Z_5$ represent no amino acid or any amino acid, independently from each other said mutation being:

either a deletion, or a substitution by A, C, D, E, F, H, I, K, L, M, P, Q, R, S, T, V, Y or W In one advantageous embodiment, the invention relates to a pharmaceutical composition comprising as active substance:

an isolated non naturally occurring mutated human or simian lentiviral ENV having substantially no immunosuppressive activity, said mutated human or simian lentiviral ENV resulting from mutation of a wild type human or simian lentiviral ENV protein, said wild type human or simian lentiviral ENV protein comprising the following amino acid sequence:

(SEQ ID NO: 415)
$A[I/V]E[K/R]YLX_1DQX_2X_3LX_4X_5WGC[A/S][F/G]X_6X_7CVX_8TX_9VPWX_{10}Z_1Z_2Z_3Z_4Z_5[N/S][E/D/N/A][S/T]$, wherein $X_1$-$X_{10}$ represents any amino acid, wherein $Z_1$ to $Z_5$ represent no amino acid or any natural amino acid, independently from each other, wherein the amino acids at the positions chosen among the position 4 of SEQ ID NO: 1, the position 5 of SEQ ID NO: 1, the position 6 of SEQ ID NO: 1, the positions 4 and 5 of SEQ ID NO: 1, the position 4 and 6 of SEQ ID NO: 1, the position 5 and 6 of SEQ ID NO: 1, and the position 4, 5 and 6 of SEQ ID NO: 1, are:

either deleted, or substituted by another amino acid such that the amino acid residue at position 4 of SEQ ID NO: 1 is substituted by A, C, D, E, F, G, H, I, L, M N, P, Q, S, T, V, W or Y, and/or the amino acid residue at position 5 of SEQ ID NO: 1 is substituted by A, C, D, E, F, G, I, L, M, N, P, Q, R, S, T, V or W, and/or the amino acid residue at position 6 of SEQ ID NO: 1 is substituted by A, C, D, E, F, G, H, I, K, M, N, P, Q, R, S, T, V, W or Y, and possibly, further wherein one at least of the amino acids at positions 29, 36 and 37 of the amino acid sequence SEQ ID NO: 415 are mutated, by either a deletion, or a substitution such that the amino acid at position 29 of SEQ ID NO: 415 is substituted by A, C, D, E, F, G, H, I, K, L, M, N, P, Q, R, S, T, V Y, the amino acid at position 36 of SEQ ID NO: 415 is substituted by A, C, D, E, F, G, H, I, K, L, M, P, Q, R, T, V, Y, W, the amino acid at position 37 of SEQ ID NO: 415 is substituted by C, F, G, H, I, K, L, M, P, Q, R, S, T, V, Y, W, and/or possibly further wherein the amino acid at position $X_4$ is either deleted or substituted by A, C, D, E, F, H, I, K, L, M P, Q, R, S, T, V, Y or W, preferably by R or H.

BRIEF DESCRIPTION OF THE DRAWINGS

FIG. 1:

Amino acid sequences of the HIV ectodomain deletants, with the indicated length, and of single mutant (substitution are underlined) ectodomains.

FIG. 2:

Functional delineation of the immunosuppressive domain of the HIV envelope. The immunosuppressive activity of 115 aa-long and truncated HIV envelope ectodomains (see structures on the left) was tested using the MCA205 tumor rejection in vivo assay. Immunosuppression indexes are given as histograms on the right (mean values+/−SD).

Figure 2:
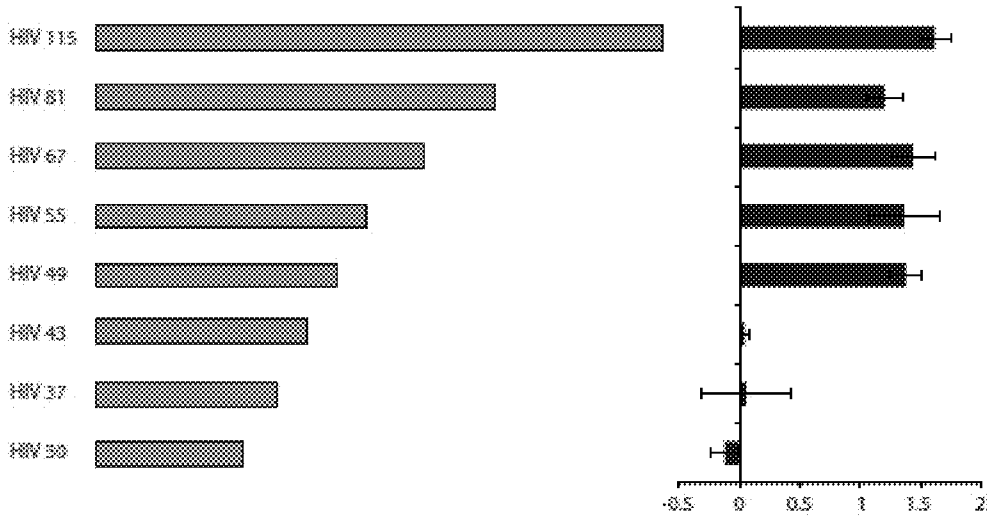

FIG. 3:

Functional identification of the aminoacid in the HIV envelope ectodomain directly involved in immunosuppressive activity, and search for aminoacid substitutions inhibiting this activity. Immunosuppresive activity was tested in vivo as in FIG. 2.

FIG. 4:

Expression profile of mutated HIV envelopes using full-length HIV env-expressing vectors and an anti-SU HIV env(110H) monoclonal antibody (FACS). The data are expressed as percentages of the control HIV env WT.

FIG. 5:

Infectivity of HIV env-pseudotyped viral particles showing functionality of the full-length WT and of specifically mutated HIV envelopes. The results are expressed as viral titers (number of infected target cells/mL of virus supematant).

FIG. 6:

Functional identification of the amino acid in the SIV envelope ectodomain directly involved in immunosuppressive activity, and search for aminoacid substitutions inhibiting this activity. Immunosuppressive activity was tested using the in vivo MCA205 tumor rejection assay. Immunosuppression indexes are represented as histograms (mean values+/−SD).

DETAILED DESCRIPTION OF THE INVENTION

Example

Immunosuppressive domains have been identified on the envelope proteins of oncoretroviruses, of either the gamma-(murine MLV) or the delta (e.g. human HTLV) type, as well as of some endogenous retroviruses (e.g. HERV-FRD). These domains have a highly conserved crystallographic structure, although their primary sequences are quite diverse, and an amino-acid (either Q, E, or K) at a definite position has previously been demonstrated to be essential for the immunosuppresive activity of the corresponding envelope protein. Mutation of this amino acid to an Arginine (R) was further demonstrated to result in inhibition of the immunosuppressive activity of the mutated envelope protein, with in some cases complete conservation of the other functional properties of the envelope protein, including its ability to be normally expressed at the cell membrane, to be captured by a nascent retroviral particle, and finally to confer infectivity of the mutant virus in vitro. Such mutants allowed an unambiguous demonstration of the essential role of the immunosuppressive activity for viremia in vivo, with the mutant IS-virus being unable to escape the host immune system and propagate in an immunocompetent animal [Schlecht-Louf et al., *Proc Natl Acad Sci USA.* 2010; 107(8): 3782-7].

On the basis of the identification of an IS domain and on the ability of the IS function to be inhibited by specific mutations within the IS domain that do not disrupt the antigenic structure of the corresponding viral protein, vaccinal approaches are being developed with vaccines containing mutated « optimized » IS-negative viral antigens, which demonstrate an increased immunognicity as compared to those using the native viral antigens. Search for similar IS domains and appropriate mutations in the case of non-oncogenic—but still pathogenic-retroviruses such as HIV is therefore of interest to tentatively develop improved vaccines.

Actually, in the case of the other major class of retroviruses, namely the lentiviruses (among which the human HIV1 and HIV2, and the SIV simian homologues), the crystallographic structure of the envelope protein discloses some similarities but also very important differences, especially in the domain corresponding to the IS domain of oncoretroviruses, with evidence in HIV and SIV for a severely extended helix-loop-helix domain, and no evidence for sequence similarities with the IS domain of oncoretroviruses.

Furthermore, an IS domain with strong amino-acid similarities with the IS domain of oncoretroviruses was identified within an accessory protein of HIV and SIV, namely within the Nef protein. This protein is specifically produced by these complex retroviruses and is not encoded by oncoretroviruses. The Nef protein is essential for viremia in vivo, and it possesses several domains responsible for immune escape, among which the identified IS domain, thus strongly suggesting that lentiviruses had transferred the immunosuppressive activity found in oncoretroviruses within their envelope protein, to the accessory Nef protein. In agreement with this hypothesis, Nef-deleted or Nef-mutated retroviruses have a severely attenuated pathogenicity in in vivo macaque animal models.

Here, the Inventors report on the identification of an IS activity carried by the HIV and SIV envelope proteins, and on specific mutations that inhibit this activity without major disrupt ion of the overall structure of the corresponding envelope proteins.

Results

Delination of the Immunosuppressive Domain of the HIV Envelope

Delineation of the immunosuppressive domain of the HIV envelope was achieved using an in vivo tumor rejection assay, that the Inventors had previously used to demonstrate the immunosuppressive activity of the Env protein of oncoretroviruses (murine MoMLV and simian MPMV). The rationale of the assay can be summarized as follows: while injection of MCA205 tumor cells (H-$2^b$) into allogeneic Balb/c mice (H-$2^d$) leads to the formation of no tumor or transient tumors that are rapidly rejected, injection of the same cells, but stably expressing an immunosuppressive retroviral Env protein, leads to the growth of larger tumors that persist for a longer time—in spite of the expression of the new exogenous antigen. This difference is not associated with a difference in intrinsic cell growth rate since it is not observed in syngeneic C57BL/6 mice, and is immune system-dependent. The extent of "immunosuppression" can be quantified by an index based on tumor size: $(A_{env}-A_{none})/A_{none}$, where $A_{env}$ and $A_{none}$ are the mean areas at the peak of growth of tumors from Balb/c mice injected with env-expressing or control cells, respectively. A positive index indicates that env expression facilitates tumor growth, as a consequence of its immunosuppressive activity; a null or negative index points to no effect or even an inhibitory effect, respectively. The latter may be explained by a stimulation of the immune response of the host against the new foreign antigen, represented by a non-immunosuppressive Env protein, expressed at the surface of tumor cells.

To first delineate a minimal immunosuppressive domain (ISD) active in vivo, the Inventors analyzed the effect of a series of truncations/deletions within the HIV env gene. Assay of the series of C-term truncations in FIGS. 1&2 identified a 49 residue-long domain with IS activity, with the 6 aa shorter HIV43 fragment and subsequent C-term truncated HIV37 and HIV30 fragments being IS-negative. HIV49 is embedded into the so-called ectodomain, which corresponds to a soluble part of the extracellular domain of the TM subunit, and consists in the a-helical domain involved in HIV TM trimerization, and the N-term part of the loop containing the 2 well-conserved, 6 aa-distant, cysteine residues found in most retroviral envelopes. Refine delineation of the amino acis responsible for IS activity was then performed by arginine-scanning between aa 36 and 51, i.e. in the domain associated with the transition from IS positive to negative Env subdomains. As illustrated in FIG. 3, all the X-to-Arg substitutions resulted in no significant change in the IS activity of HIV115, with one exception for Y41 and L42, which resulted in loss of IS activity of the mutant peptide.

Mutations at Position 41

The Inventors then checked that the Y41R substitution did not alter the overall capacity of the HIV envelope to be expressed by an eucaryotic cell and to be exported at the cell membrane, by introducing the Y41R substitution into an expression vector for the HIV envelope. A FACS analysis of cell transfected with both the wild-type and the Y41R mutant using an anti-SU specific monoclonal antibody actually demonstrated quantitative expression of the mutant envelope at the cell surface, thus indicating that the Y41R mutation does not significantly alter the HIV Env structure and SU-TM interaction (FIG. 4).

A series of distinct substitutions at the Y41 position were finally performed to tentatively identify whether other amino acids could be substituted to generate IS-negative variants: the amino acid assayed included the positively charged K and H (in addition to R), the small A and G, and the hydrophobic L and F residues. Again it was checked that these substitutions did not alter the overall structure of the HIV Env with the corresponding mutations.

Figure 4:
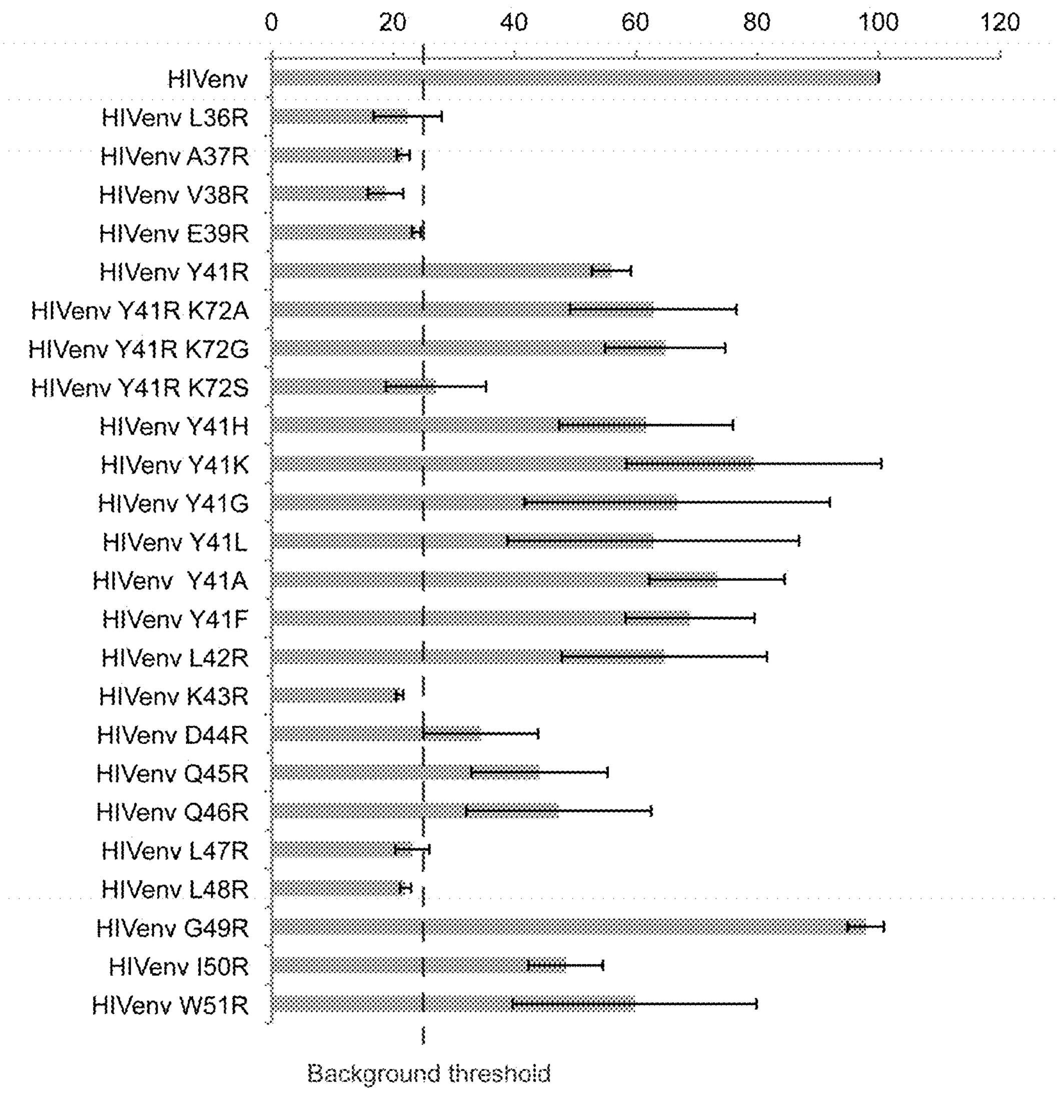
Figure 5:
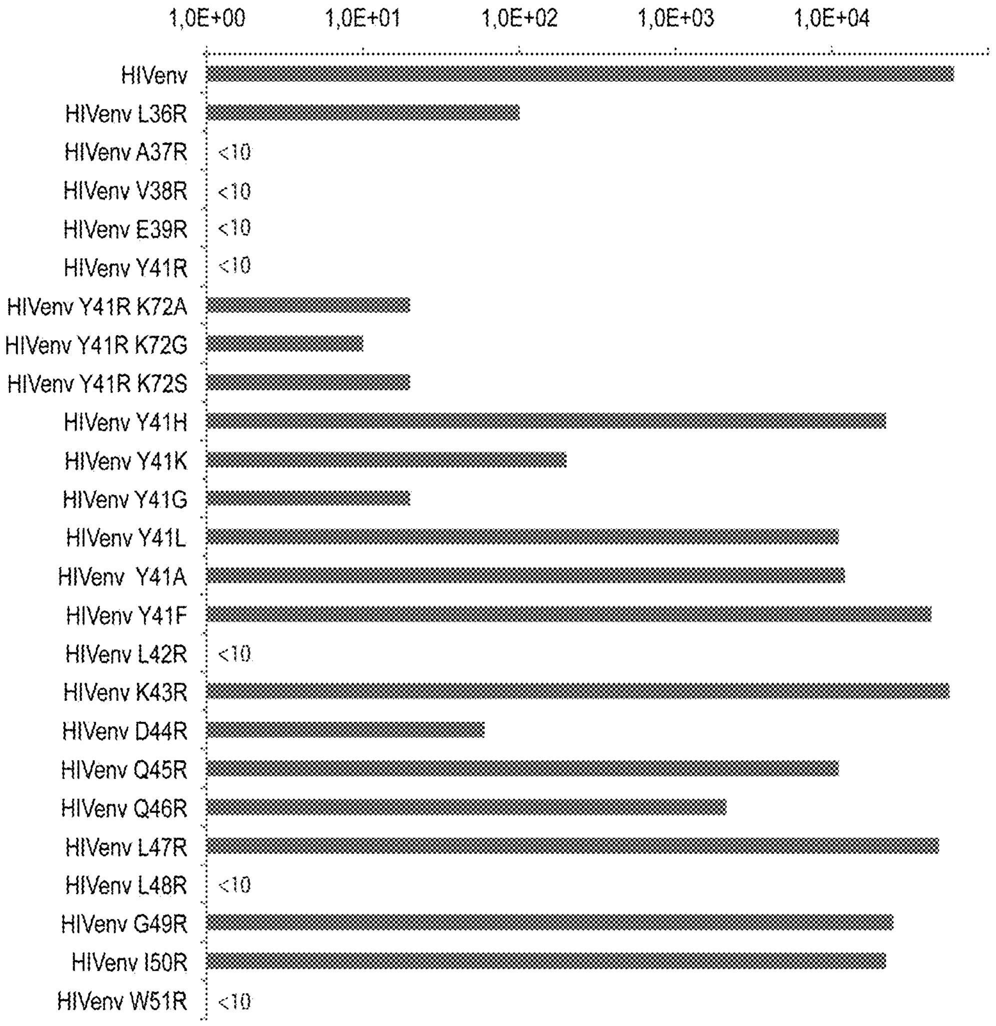

Among them, substitution of Y41 by A, G, L and F resulted in loss of IS (FIG. 3), and did not alter the overall structure of the HIV Env with the corresponding mutations (FIGS. 4 and 5).

Further Mutation Outside of the ISU Domain

The effects of a set of second mutations at positions that are structurally close to Y41 position within the ENV ectodomain three-dimensional structure were also tested. Two of them (Y41R-K72A and Y41R-K78G) maintain a high level expression at cell membrane and confer infectivity (FIG. 5).

Mutations at Position 42

Interestingly, the adjacent position to the position Y41, position L42, also resulted in loss of IS activity of the mutant peptide when the mutation L42R is introduced. This mutation maintains a high level expression at cell membrane of the mutated HIV ENV protein (FIG. 4).

Mutations within the SIV ENV Protein

Figure 6:
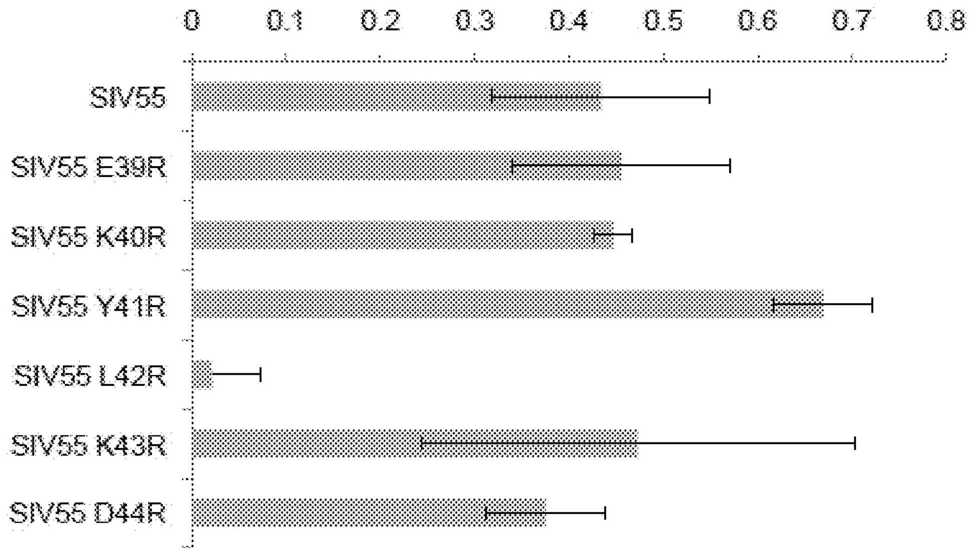

Interestingly, mutation at the homologous position in SIV ENV (L42) of the position L42 in HIV-1 ENV ectodoamin also resulted in specific loss of IS activities (FIG. 6).

Accordingly, the present investigation has clearly identified a definite location and a definite substitution(s) within the HIV env resulting in the loss of its IS activity. Being compatible with the conservation of the overall structure of the human and simian lentiviral Env proteins, these substitutions should be introduced in all pharmaceutical preparations which include the Env protein as a vaccine antigen.

Materials and Methods

Mice and cell lines: C57Bl/6 and Balb/c mice, 6-10 weeks old, were obtained from CER Janvier (Laval, France). Mice were maintained in the animal facility of the Gustave Roussy Institute in accordance with institutional regulations. 293T (ATCC CRL11268), and MCA205 cells were cultured in DMEM supplemented with 10% fetal calf serum (Invitrogen), streptomycin (100 μg/ml) and penicillin (100 units/ml).

Plasmid Construction:

The PCEL/E160 encoding the envelope protein of the BRU/LAI HIV-1 isolate is a gift from Dr Marc Sitbon. To generate the pDFG plasmids encoding the various fragments of HIV-1 envelope ectodomain, PCR fragments generated using PCEL/E160 as a template and primer pairs 1-2 (pDFG-HIV115), 1-3 (pDFG-HIV81), 1-4 (pDFG-HIV67), 1-5 (pDFG-HIV55), 1-6 (pDFG-HIV49), 1-7 (pDFG-HIV43), 1-8 (pDFG-HIV37), 1-9 (pDFG-HIV30) were digested with SfiI and MluI and inserted into pDFG-ecto-Syncytin-1 (Mangeney et al, 2007) opened with the same enzymes.

Mutated pDFG-HIV115 were obtained by successive PCR using appropriate primers. A first series of PCR was performed with pDFG HIV115 as template using primers 1-11 and 10-2, 1-13 and 12-2, 1-15 and 14-2 or 1-17 and 16-2 to introduce the E39R, Y41R, K43R or D44R mutations respectively, and primers 1-18 and 19-2, 1-20 and 21-2, 1-22 and 23-2, 1-24 and 25-2, 1-26 and 27-2, 1-28 and 29-2, 1-30 and 31-2, 1-32 and 33-2, 1-34 and 35-2, or 1-36 and 37-2 to introduce the L36R, A37R, V38R, L42R, Q45R, Q46R, L47R, L48R, G49R, or I50R mutations respectively. The PCR products were then used as templates in subsequent PCR using primers 1-2. These PCR fragments were digested with SfiI and MluI and inserted into pDFG-ecto-Syncytin-1 (Mangeney et al, 2007) opened with the same enzymes.

All the constructions were sequenced before use.

TABLE 1

| Primer list | | | |
|---|---|---|---|
| N° | Name | Primer sequence (5'-3') | SEQ ID |
| 1 | TM HIV Sfi-Sens | ACATggcccagccggccTCTGGTATAGTGCAGCAGC | SEQ ID NO: 295 |
| 2 | TM HIV115 Mlu-AS | GTATacgcgtTTATAATTCTTGTTCATTCTTTTC | SEQ ID NO: 296 |

TABLE 1-continued

Primer list

| N° | Name | Primer sequence (5'-3') | SEQ ID |
|---|---|---|---|
| 3 | TM HIV81 Mlu AS | GTATacgcgtTTACATGTTATTCCAAATCTGTTCC | SEQ ID NO: 297 |
| 4 | TM HIV67 Mlu AS | GTATacgcgtTTAAGCATTCCAAGGCACAGC | SEQ ID NO: 298 |
| 5 | TM HIV55 Mlu AS | GTATacgcgtTTATCCAGAGCAACCCCAAATCC | SEQ ID NO: 299 |
| 6 | TMHIV49 Mlu AS | GTATacgcgtTTACCCCAGGAGCTGTTGATCC | SEQ ID NO: 300 |
| 7 | TMHIV43 Mlu AS | GTATacgcgtTTACTTTAGGTATCTTTCCACAGC | SEQ ID NO: 301 |
| 8 | TMHIV37 Mlu AS | GTATacgcgtTTAAGCCAGGATTCTTGCCTGGAG | SEQ ID NO: 302 |
| 9 | TMHIV30 Mlu AS | GTATacgcgtTTACTGCTTGATGCCCCAGAC | SEQ ID NO: 303 |
| 18 | TMHIV115 L36R as | CTTTCCACAGCCcGGATTCTTGCCTG | SEQ ID NO: 304 |
| 19 | TMHIV115 L36R s | CAGGCAAGAATCCgGGCTGTGGAAAG | SEQ ID NO: 305 |
| 20 | TMHIV115 A37R as | GTATCTTTCCACAcgCAGGATTCTTGCC | SEQ ID NO: 306 |
| 21 | TMHIV115 A37R s | GGCAAGAATCCTGcgTGTGGAAAGATAC | SEQ ID NO: 307 |
| 22 | TMHIV115 V38R as | CTTTAGGTATCTTTCCctAGCCAGGATTCTTGCC | SEQ ID NO: 308 |
| 23 | TMHIV115 V38R s | GGCAAGAATCCTGGCTagGGAAAGATACCTAAAG | SEQ ID NO: 309 |
| 11 | TMHIV115 E39R AS | CCTTTAGGTATCTTctCACAGCCAGGATTC | SEQ ID NO: 310 |
| 10 | TMHIV115 E39R S | GAATCCTGGCTGTGagAAGATACCTAAAGG | SEQ ID NO: 311 |
| 13 | TMHIV115 Y41R AS | GTTGATCCTTTAGGcgTCTTTCCACAGCCAG | SEQ ID NO: 312 |
| 12 | TMHIV115 Y41R S | CTGGCTGTGGAAAGAcgCCTAAAGGATCAAC | SEQ ID NO: 313 |
| 24 | TMHIV115 L42R as | GGAGCTGTTGATCCTTTcGGTATCTTTCCACAGCC | SEQ ID NO: 314 |
| 25 | TMHIV115 L42R s | GGCTGTGGAAAGATACCgAAAGGATCAACAGCTCC | SEQ ID NO: 315 |
| 15 | TMHIV115 K43R AS | GAGCTGTTGATCCcTTAGGTATCTTTCCAC | SEQ ID NO: 316 |
| 14 | TMHIV115 K43R S | GTGGAAAGATACCTAAgGGATCAACAGCTC | SEQ ID NO: 317 |
| 17 | TMHIV115 D44R AS | AGGAGCTGTTGAcgCTTTAGGTATCTTT | SEQ ID NO: 318 |
| 16 | TMHIV115 D44R S | AAAGATACCTAAAGcgTCAACAGCTCCT | SEQ ID NO: 319 |
| 26 | TMHIV115 Q45R as | CCCAGGAGCTGTcGATCCTTTAGGTATC | SEQ ID NO: 320 |
| 27 | TMHIV115 Q45R s | GATACCTAAAGGATCgACAGCTCCTGGG | SEQ ID NO: 321 |
| 28 | TMHIV115 Q46R as | CAAATCCCCAGGAGCcGTTGATCCTTTAG | SEQ ID NO: 322 |
| 29 | TMHIV115 Q46R s | CTAAAGGATCAACgGCTCCTGGGGATTTG | SEQ ID NO: 323 |
| 30 | TMHIV115 L47R as | CAAATCCCCAGGcGCTGTTGATCCTTTAG | SEQ ID NO: 324 |
| 31 | TMHIV115 L47R s | CTAAAGGATCAACAGCgCCTGGGGATTTG | SEQ ID NO: 325 |
| 32 | TMHIV115 L48R as | CCCAAATCCCCcGGAGCTGTTG | SEQ ID NO: 326 |
| 33 | TMHIV115 L48R s | CAACAGCTCCgGGGGATTTGGG | SEQ ID NO: 327 |
| 34 | TMHIV115 G49R as | CCCCAAATCCgCAGGAGCTGTTG | SEQ ID NO: 328 |
| 35 | TMHIV115 G49R s | CAACAGCTCCTGcGGATTTGGGG | SEQ ID NO: 329 |
| 36 | TMHIV115 150R as | GCAACCCCAtcTCCCCAGGAGCTG | SEQ ID NO: 330 |
| 37 | TMHIV115 150R s | CAGCTCCTGGGGAgaTGGGGTTGC | SEQ ID NO: 331 |
| 38 | TMHIV115 W51R as | GCAACCCCAtcTCCCCAGGAGCTG | SEQ ID NO: 332 |
| 39 | TMHIV115 W51R s | CAGCTCCTGGGGAgaTGGGGTTGC | SEQ ID NO: 333 |

HIV115 Y41 Mutant Construction:

To explore the amino acid sequence necessary for the loss of immunosuppression, HIV115 Y41 mutants were produced by PCR using the pDFG HIV115 WT plasmid as template and pairs of primers 1-42 and 43-2, 1-44 and 45-2, 1-46 and 47-2, 1-48 and 49-2, 1-50 and 51-2, or 1-52 and 53-2, to introduce the Y41K, Y41H, Y41A, Y41G, Y41F, or Y41L mutations respectively. The PCR products were then used as templates in subsequent PCR using primers 1-2. These PCR fragments were digested with SfiI and MluI and inserted into pDFG-ectoSyncytin-1 (Mangeney et al, 2007) opened with the same enzymes All the constructions were sequenced before use.

| N° | Name | Primer sequence (5'-3') | SEQ ID NO |
|---|---|---|---|
| 42 | TMHIV115 Y41K as | GTTGATCCTTTAGtTtTCTTTCCACAGCCAG | SEQ ID NO: 334 |
| 43 | TMHIV115 Y41K s | CTGGCTGTGGAAAGAaAaCTAAAGGATCAAC | SEQ ID NO: 335 |
| 44 | TMHIV115 Y41H as | GTTGATCCTTTAGGTgTCTTTCCACAGCCAG | SEQ ID NO: 336 |
| 45 | TMHIV115 Y41H s | CTGGCTGTGGAAAGAcACCTAAAGGATCAAC | SEQ ID NO: 337 |
| 46 | TMHIV115 Y41A as | GTTGATCCTTTAGGgcTCTTTCCACAGCCAG | SEQ ID NO: 338 |
| 47 | TMHIV115 Y41A s | CTGGCTGTGGAAAGAgcCCTAAAGGATCAAC | SEQ ID NO: 339 |
| 48 | TMHIV115 Y41G as | GTTGATCCTTTAGGccTCTTTCCACAGCCAG | SEQ ID NO: 340 |
| 49 | TMHIV115 Y41G s | CTGGCTGTGGAAAGAggCCTAAAGGATCAAC | SEQ ID NO: 341 |
| 50 | TMHIV115 Y41F as | GTTGATCCTTTAGGaATCTTTCCACAGCCAG | SEQ ID NO: 342 |
| 51 | TMHIV115 Y41F s | CTGGCTGTGGAAAGATtCCTAAAGGATCAAC | SEQ ID NO: 343 |
| 52 | TMHIV115 Y41L as | GTTGATCCTTTAGGagTCTTTCCACAGCCAG | SEQ ID NO: 344 |
| 53 | TMHIV115 Y41L s | CTGGCTGTGGAAAGActCCTAAAGGATCAAC | SEQ ID NO: 345 |

HIV115 Y41 Double Mutants Construction:

HIV115 Y41R K72A, G or S double mutants were produced by PCR using the pDFG HIV115 Y41R plasmid as template and pairs of primers 1-94 and 93-2, 1-96 and 95-2, or 1-98 and 97-2. The PCR products were then used as templates in subsequent PCR using primers 1-2. These PCR fragments were digested with SfiI and MluI and inserted into pDFG-ectoSyncytin-1 (Mangeney et al, 2007) opened with the same enzymes. HIV115 R40X Y41R double-mutants were produced by PCR using the pDFG HIV115 Y41R as template and pairs of primers 1-54 and 55-2, 1-56 and 57-2 to introduce the R40A and R40E mutations respectively. HIV115 R40X Y41A double-mutants were produced by PCR using the pDFG HIV115 Y41A as template and pairs of primers 1-58 and 59-2, 1-60 and 61-2, 1-62 and 63-2, 1-64 and 65-2 to introduce the R40A, R40E, R40S, R40T mutations respectively. HIV115 R40X simple mutants were also generated using pDFG HIV 115 WT as template and pairs of primers 1-66 and 67-2, 1-68 and 69-2, 1-70 and 71-2, 1-72 and 73-2.

The PCR products were then used as templates in subsequent PCR using primers 1-2. These PCR fragments were digested with SfiI and MluI and inserted into pDFG-ectoSyncytin-1 (Mangeney et al, 2007) opened with the same enzyme.

| N° | Name | Primer sequence (5'-3') | SEQ ID |
|---|---|---|---|
| 54 | TM HIV115 R40AY41R-S | CTGGCTGTGGAAgcAcgCCTAAAGGATCAAC | SEQ ID NO: 378 |
| 55 | TM HIV115 R40AY41R-AS | GTTGATCCTTTAGGcgTgcTTCCACAGCCAG | SEQ ID NO: 379 |
| 56 | TM HIV115 R40EY41R-S | CTGGCTGTGGAAgaAcgCCTAAAGGATCAAC | SEQ ID NO: 380 |

-continued

| N° | Name | Primer sequence (5'-3') | SEQ ID |
|---|---|---|---|
| 57 | TM HIV115 R40EY41R-AS | GTTGATCCTTTAGGcgTtcTTCCACAGCCAG | SEQ ID NO: 381 |
| 58 | TM HIV115 R40AY41A-S | CTGGCTGTGGAAgctgcCCTAAAGGATCAAC | SEQ ID NO: 382 |
| 59 | TM HIV115 R40AY41A-AS | GTTGATCCTTTAGGgcagcTTCCACAGCCAG | SEQ ID NO: 383 |
| 60 | TM HIV115 R40EY41A-S | CTGGCTGTGGAAgaagcCCTAAAGGATCAAC | SEQ ID NO: 384 |
| 61 | TM HIV115 R40EY41A-AS | GTTGATCCTTTAGGgcttcTTCCACAGCCAG | SEQ ID NO: 385 |
| 62 | TM HIV115 R40SY41A-S | CTGGCTGTGGAAagcgcCCTAAAGGATCAAC | SEQ ID NO: 386 |
| 63 | TM HIV115 R40SY41A-AS | GTTGATCCTTTAGGgcgctTTCCACAGCCAG | SEQ ID NO: 387 |
| 64 | TM HIV115 R40TY41A-S | CTGGCTGTGGAAacagcCCTAAAGGATCAAC | SEQ ID NO: 388 |
| 65 | TM HIV115 R40TY41A-AS | GTTGATCCTTTAGGgctgtTTCCACAGCCAG | SEQ ID NO: 389 |
| 66 | TM HIV115 R40A-S | CTGGCTGTGGAAgctTACCTAAAGGATCAAC | SEQ ID NO: 390 |
| 67 | TM HIV115 R40A-AS | GTTGATCCTTTAGGTAagcTTCCACAGCCAG | SEQ ID NO: 391 |
| 68 | TM HIV115 R40E-S | CTGGCTGTGGAAgaaTACCTAAAGGATCAAC | SEQ ID NO: 392 |
| 69 | TM HIV115 R40E-AS | GTTGATCCTTTAGGTAttcTTCCACAGCCAG | SEQ ID NO: 393 |
| 70 | TM HIV115 R40S-S | CTGGCTGTGGAAagcTACCTAAAGGATCAAC | SEQ ID NO: 394 |
| 71 | TM HIV115 R40S-AS | GTTGATCCTTTAGGTAgctTTCCACAGCCAG | SEQ ID NO: 395 |
| 72 | TM HIV115 R40T-S | CTGGCTGTGGAAacaTACCTAAAGGATCAAC | SEQ ID NO: 396 |
| 73 | TM HIV115 R40T-AS | GTTGATCCTTTAGGTAtgtTTCCACAGCCAG | SEQ ID NO: 397 |
| 93 | TMHIV115 K72A s | GCTAGTTGGAGTAATgcATCTCTGGAACAGATTTGG | SEQ ID NO: 398 |
| 94 | TMHIV115 K72A as | CCAAATCTGTTCCAGAGATgcATTACTCCAACTAGC | SEQ ID NO: 399 |
| 95 | TMHIV115 K72G s | GCTAGTTGGAGTAATggATCTCTGGAACAGATTTGG | SEQ ID NO: 400 |
| 96 | TMHIV115 K72G as | CCAAATCTGTTCCAGAGATccATTACTCCAACTAGC | SEQ ID NO: 401 |
| 97 | TMHIV115 K72S s | GCTAGTTGGAGTAATtcATCTCTGGAACAGATTTGG | SEQ ID NO: 402 |
| 98 | TMHIV115 K72S as | CCAAATCTGTTCCAGAGATgaATTACTCCAACTAGC | SEQ ID NO: 403 |

Introduction of HIV115 Mutations into an HIV Env Expression Vector:

To introduce these HIV envelope mutations into the HIV env pTr712 expression vector (Schnierle et al PNAS 1997), a silent mutation was first generated to create an SfiI insertion site. PCR fragments were generated using pTr712 as a template and primer pairs 38-39 and 40-41. The PCR products were then used as templates in subsequent PCR using primers 38-41. The resulting PCR fragment was then digested with BsaBI and HindIII and inserted into the pTr712 plasmid opened with the same enzymes resulting in the pTr712-Sfi plasmid. PCR fragments of each HIV115 mutation were then generated by using primers 40-41 and the pDFG HIV115 mutant plasmids as templates, digestion with SfiI and HindIII and then insertion into the pTr712-Sfi plasmid opened with the same enzymes.

All the constructions were sequenced before use.

| N° | Name | Primer sequence (5'-3') | SEQ ID NO |
|---|---|---|---|
| 38 | HIV BH10 BsaBI s | acaaattagatgttcatcaaatattacaggg | SEQ ID NO: 346 |
| 39 | HIV BH10 SfiI mutsil as | GCAACAGATGCTGTTGgGCCTCAATgGCCCTCAGCA AATTGTTC | SEQ ID NO: 347 |
| 40 | HIV BH10 SfiI mutsil s | GAACAATTTGCTGAGGGCcATTGAGGCcCAACAGCA TCTGTTGC | SEQ ID NO: 348 |
| 41 | HIV BH10 HindIII as | gtgtattaagcttgtgtaattgttaatttctc | SEQ ID NO: 349 |
| 74 | EnvHIVTr712-Xho-Age-Kozak-S | NNNNNCTCGAGACCGGTccaactagaaccATGAGAGTGA AGGAGAAATATCAGC | SEQ ID NO: 404 |
| 75 | EnvHIVTr712-Mlu-AS | NNNNNACGCGTTCAATATCCCTGCCTAACTC | SEQ ID NO: 405 |
| 76 | EnvHIVWT-Mlu-AS | NNNNNACGCGTTTATAGCAAAATCCTTTCCAAGC | SEQ ID NO: 406 |

Establishment of Env-Expressing Tumor Cells and MCA205 Tumor-Rejection Assay:

$7.5\times10^5$ 293T cells were cotransfected with the env-expressing pDFG retroviral vector to be tested (1.75 g) and expression vectors for the MLV proteins (0.55 g for the amphotropic MLV env vector and 1.75 g for the MLV gag and pol vector). 36 hours post-transfection, supernatants were harvested for infection of MCA205 tumor cells (2.5 ml of supernatant per $5\times10^5$ cells with 8 µg/ml polybrene). Cells were maintained in selective medium (400 units/ml hygromycin) for 3 weeks, and then washed with PBS, trypsinized and inoculated subcutaneously in the shaved area of each mouse right flank as in Mangeney et al (1998, 2007). Tumor growth was monitored by palpation twice or thrice weekly and tumor area ($mm^2$) determined by measuring perpendicular tumor diameters. The extent of "immunosuppression" was quantified by an index based on tumor size: $(A_{env}-A_{none})/A_{none}$, where $A_{env}$ and $A_{none}$ are the mean areas at the peak of growth of tumors from Balb/c mice injected with env-expressing or control cells, respectively.

Analysis of HIV Env Expression:

293T cells were transfected with 4 mg of the expression vector for the HIV-1 envelope (pTr712) either wild-type or mutated at the indicated positions, by Calcium Phosphate precipitation. Cells are washed 16 h later and then harvested 2 days post-transfection using PBS-EDTA 5 mM. The 110-H monoclonal antibody (anti-V3 loop, gift from Hybridolab, Pasteur Institute) was used (1/200 dilution) to stain the HIV envelope. As a secondary antibody, the Inventors used the goat anti mouse IgG Alexa 488 (1/400) (Invitrogen). For intracellular HIV env staining, 293T cells were fixed with a formaldehyde buffer and then permeabilized (BD cytofix/cytoperm, BD Biosciences). The isotype mouse anti IgG1Kappa (BD Biosciences) was used to control non-specific staining. Fluorescence was acquired by flow cytometry using a FACS Calibur (BD Biosciences), and data analysed by the CellQuest software (BD Biosciences).

Mutated Env Pseudotyping and Measure of Viral Titer:

293T cells are triple transfected with 3 mg of a reporter MLV vector carrying GFP (CNCG), 1.75 mg Mo-MLV gag-pol vector and 0.55 mg phCMV vector encoding HIV-1 envelope wt or mutated at the indicated positions. The infectivity of Mo-MLV virions pseudotyped with HIV-1 Env, harvested 48 hours post-transfection, is measured using U87 cells ($CD4^+$, $CXCR4^+$) as target cells. The infectivity of the enveloppes is analysed after 72 h exposure diluted 0.45 mm-filtered supernatant in presence of 4 mg/mL polybrene. The fluorescence (GFP) is acquired by flow cytometry using a FACS Calibur (BD Biosciences). The results are analysed by the CellQuest software (BD Biosciences). The resulting titers (number of infected cells/mL) are calculated as the following: (% $GFP^+$ cells (infected)×plated cell number)/volume of supernatant×1000.

Env SIV Mutants Construction:

PCR fragments were generated using p239 SPE3' (the plasmid encoding the SIV half virus containing the envelope protein) as a template and primer pairs 77-79 and 78-80, 77-81 and 78-82, 77-83 and 78-84, 77-85 and 78-86, 77-87 and 78-88, 77-89 and 78-90 to introduce the E39R, K40R, Y41R, L42R, K43R, D44R mutations respectively. The PCR products were the used as templates in subsequent PCR using primers 77-78. The resulting PCR fragment was then digested with BmgBI and NheI and inserted into the p239 SPE3' plasmid opened with the same enzymes.

All the constructions were sequenced before use.

Introduction of SIV Mutants Ectodomain into pDFG:

To generate the pDFG plasmids encoding the fragment of SIV envelope ectodomain-55, PCR fragments generated using p239 SPE3' WT and mutants as a template and primer pairs 91-92, were digested with SfiI and MluI and inserted into pDFG opened with the same enzymes.

| | | |
|---|---|---|
| 77 Env SIV S | ccgctcagtcccgaactttattggc | SEQ ID NO: 350 |
| 78 Env SIV AS | ggtggggaagagaacactggcc | SEQ ID NO: 351 |
| 79 SIV env E39R s | cagactagggtcactgccatcCGCaagtacttaaaggaccaggcg | SEQ ID NO: 352 |
| 80 SIV env E39R as | cgcctggtcctttaagtacttGCGgatggcagtgaccctagtctg | SEQ ID NO: 353 |
| 81 SIV env K40R s | actagggtcactgccatcgagCGCtacttaaaggaccaggcgcag | SEQ ID NO: 354 |
| 82 SIV env K40R as | ctgcgcctggtcctttaagtaGCGctcgatggcagtgaccctagt | SEQ ID NO: 355 |
| 83 SIV env Y41R s | GCCATCGAGAAGcgCTTAAAGGACCAGGCG | SEQ ID NO: 356 |
| 84 SIV env Y41R as | CGCCTGGTCCTTTAAGcgCTTCTCGATGGC | SEQ ID NO: 357 |
| 85 SIV env L42R s | gtcactgccatcgagaagtacCGCaaggaccaggcgcagctg | SEQ ID NO: 358 |
| 86 SIV env L42R as | cagctgcgcctggtccttGCGgtacttctcgatggcagtgac | SEQ ID NO: 359 |
| 87 SIV env K43R s | gccatcgagaagtacttaCGCgaccaggcgcagctgaatgcttgg | SEQ ID NO: 360 |
| 88 SIV env K43R as | ccaagcattcagctgcgcctggtcGCGtaagtacttctcgatggc | SEQ ID NO: 361 |
| 89 SIV env D44R s | gagaagtacttaaagCGCcaggcgcagctgaatgcttgg | SEQ ID NO: 362 |
| 90 SIV env D44R as | attcagctgcgcctgGCGctttaagtacttctcgatggc | SEQ ID NO: 363 |
| 91 TMSIV55 Sfi S | ACATggcccagccggccgctgggatagtgcagcaac | SEQ ID NO: 364 |
| 92 TMSIV55 Mlu AS | GTATacgcgtTTAaaacgcacatccccaagcattc | SEQ ID NO: 365 |

Comparative Example

Test of the In Vivo Effect of the Mutation G49R, which Corresponds to the Mutation "G19R" in the International Application WO 2010/022,740

WO 2010/022,740 discloses a consensus sequence of 50 amino acid of the HIV ENV protein. In this sequence, it is suggested that substitution of amino acids in positions 10, 19, 24, 34 and 40 affect the immunosuppressive properties of the HIV ENV protein.

These mutations are a transposition in lentivirus of the teaching of WO 2005/095,442 limited to endogenous or onco retroviruses. The authors of WO 2005/095,442 are also the authors of the present application and they early observed that such a transposition is not effective.

Despite the fact that any amino acids can be assigned to the positions 10, 19, 24, 34 or 40 in the consensus sequence of WO 2010/022,740, only one substitution (one residue for one position) was tested by ex vivo experiments in WO 2010/022,740. It is the mutation "G19R", which corresponds to the mutation G49R in the present FIGS. 1 and 3.

Because the immune response of an individual involves different organs and different cellular and non-cellular components, ex vivo results have no predictive value concerning the in vivo immunosuppressive properties of a viral protein.

To determine if the mutations previously disclosed in WO 2010/022,740 are suitable for a medical use, the mutation G49R has been tested using the MCA205 tumor rejection in vivo assay, as defined in the section "Establishment of env-expressing tumor cells and MCA205 tumor-rejection assay" of the Example.

As shown in FIG. 3, the peptide G49R remains almost as immunosuppressive in vivo as the wild type HIV 115 peptide, with an immunosuppression index which is higher than 0.5. Thus, the mutation G49R does not induce a significant decrease of the in vivo immunosuppressive properties of the HIV ENV protein, with a ratio of immunosuppression index of G49R mutated ENV HIV 115 peptide ($i_{mutated\ env}$)/immunosuppression index of wild type ENV HIV 115 peptide ($i_{wild\ type\ env}$), which is 0.7 (i.e. higher than 0.5).

This result demonstrates the insufficiently described teaching of WO 2010/022,740 since the only one mutation tested in WO 2010/022,740, using an ex vivo test, does not significantly affect the in vivo immunosuppressive properties of the HIV ENV protein.

As a consequence, WO 2010/022,740 raises the same technical problem as the present invention but does not offer a technical solution.

SEQUENCE LISTING (462 sequences)

SEQ ID NO: 1 - protein, 9 aa, Artificial Sequence
  fragment of lentiviral ENV ISU
  MISC_FEATURE (2)..(2): Xaa = Ile or Val
  MISC_FEATURE (4)..(4): Xaa = K or R
  misc_feature (7)..(7): Xaa can be any naturally occurring amino acid
AXEXYLXDQ

SEQ ID NO: 2 - protein, 9 aa, Artificial Sequence
  fragement of lentiviral ENV ISU
  misc_feature (7)..(7): Xaa can be any naturally occurring amino acid
AIEKYLXDQ

SEQ ID NO: 3 - protein, 9 aa, Artificial Sequence
  fragement of lentiviral ENV ISU
  misc_feature (7)..(7): Xaa can be any naturally occurring amino acid
AIERYLXDQ

SEQ ID NO: 4 - protein, 9 aa, Artificial Sequence
  fragment of lentiviral ENV ISU
  misc_feature (7)..(7): Xaa can be any naturally occurring amino acid
AVEKYLXDQ

SEQ ID NO: 5 - protein, 9 aa, Artificial Sequence
  fragment of lentiviral ENV ISU
  misc_feature (7)..(7): Xaa can be any naturally occurring amino acid
AVERYLXDQ

SEQ ID NO: 6 - protein, 49 aa, Artificial Sequence
  fragment of lentiviral ENV ISU
  misc_feature (1)..(1): Xaa can be any naturally occurring amino acid
  misc_feature (8)..(9): Xaa can be any naturally occurring amino acid
  misc_feature (12)..(17): Xaa can be any naturally occurring amino acid
  misc_feature (19)..(20): Xaa can be any naturally occurring amino acid
  misc_feature (22)..(22): Xaa can be any naturally occurring amino acid
  misc_feature (24)..(25): Xaa can be any naturally occurring amino acid
  misc_feature (28)..(28): Xaa can be any naturally occurring amino acid
  misc_feature (30)..(30): Xaa can be any naturally occurring amino acid
  misc_feature (33)..(33): Xaa can be any naturally occurring amino acid
  misc_feature (35)..(36): Xaa can be any naturally occurring amino acid
  MISC_FEATURE (38)..(38): Xaa = I or V
  MISC_FEATURE (40)..(40): Xaa = R or K
  misc_feature (43)..(43): Xaa can be any naturally occurring amino acid
  misc_feature (46)..(47): Xaa can be any naturally occurring amino acid
  misc_feature (49)..(49): Xaa can be any naturally occurring amino acid
XGIVQQQXXLLXXXXXXQXXLXLXXWGXKXLQXRXXAXEXYLXDQXXLX

SEQ ID NO: 7 - protein, 9 aa, Artificial Sequence
  fragment of lentiviral ENV ISU
AVERYLKDQ

SEQ ID NO: 8 - protein, 9 aa, Artificial Sequence
  fragment of lentiviral ENV ISU
AIEKYLKDQ

SEQ ID NO: 9 - protein, 8 aa, Artificial Sequence
  fragment of lentiviral ENV ISU
AVERALKD

SEQ ID NO: 10 - protein, 8 aa, Artificial sequence
  fragment of lentiviral ENV ISU
AVERFLKD

SEQ ID NO: 11 - protein, 8 aa, Artificial sequence
  fragment of lentiviral ENV ISU
AVERGLKD

SEQ ID NO: 12 - protein, 8 aa, Artificial sequence
  fragment of lentiviral ENV ISU
AVERLLKD

SEQ ID NO: 13 - protein, 8 aa, Artificial sequence
  fragment of lentiviral ENV ISU
AVERRLKD

SEQ ID NO: 14 - protein, 8 aa, Artificial sequence
  fragment of lentiviral ENV ISU
AVERYAKD

SEQ ID NO: 15 - protein, 8 aa, Artificial sequence
  fragment of lentiviral ENV ISU
AVERYFKD

SEQ ID NO: 16 - protein, 8 aa, Artificial sequence
  fragment of lentiviral ENV ISU
AVERYGKD

SEQ ID NO: 17 - protein, 8 aa, Artificial sequence
  fragment of lentiviral ENV ISU
AVERYRKD

SEQ ID NO: 18 - protein, 8 aa, Artificial sequence
  fragment of lentiviral ENV ISU
AVERAAKD

SEQ ID NO: 19 - protein, 8 aa, Artificial sequence
  fragment of lentiviral ENV ISU
AVERAFKD

SEQ ID NO: 20 - protein, 8 aa, Artificial sequence
  fragment of lentiviral ENV ISU
AVERAGKD

SEQ ID NO: 21 - protein, 8 aa, Artificial sequence
  fragment of lentiviral ENV ISU
AVERARKD

SEQ ID NO: 22 - protein, 8 aa, Artificial sequence
  fragment of lentiviral ENV ISU
AVERFAKD

SEQ ID NO: 23 - protein, 8 aa, Artificial sequence
  fragment of lentiviral ENV ISU
AVERFFKD

SEQ ID NO: 24 - protein, 8 aa, Artificial sequence
  fragment of lentiviral ENV ISU
AVERFGKD

SEQ ID NO: 25 - protein, 8 aa, Artificial sequence
  fragment of lentiviral ENV ISU
AVERFRKD

SEQ ID NO: 26 - protein, 8 aa, Artificial sequence
  fragment of lentiviral ENV ISU
AVERGAKD

SEQ ID NO: 27 - protein, 8 aa, Artificial sequence
  fragment of lentiviral ENV ISU
AVERGFKD

SEQ ID NO: 28 - protein, 8 aa, Artificial sequence
  fragment of lentiviral ENV ISU
AVERGGKD

SEQ ID NO: 29 - protein, 8 aa, Artificial sequence
  fragment of lentiviral ENV ISU
AVERGRKD

SEQ ID NO: 30 - protein, 8 aa, Artificial sequence
  fragment of lentiviral ENV ISU
AVERLAKD

SEQ ID NO: 31 - protein, 8 aa, Artificial sequence
  fragment of lentiviral ENV ISU
AVERLFKD

SEQ ID NO: 32 - protein, 8 aa, Artificial sequence
  fragment of lentiviral ENV ISU
AVERLGKD

SEQ ID NO: 33 - protein, 8 aa, Artificial sequence
  fragment of lentiviral ENV ISU
AVERLRKD

SEQ ID NO: 34 - protein, 8 aa, Artificial sequence
  fragment of lentiviral ENV ISU
AVERRAKD

SEQ ID NO: 35 - protein, 8 aa, Artificial sequence
  fragment of lentiviral ENV ISU
AVERRFKD

SEQ ID NO: 36 - protein, 8 aa, Artificial sequence
  fragment of lentiviral ENV ISU
AVERRGKD

SEQ ID NO: 37 - protein, 8 aa, Artificial sequence
  fragment of lentiviral ENV ISU
AVERRRKD

SEQ ID NO: 38 - protein, 8 aa, Artificial sequence
  fragement of lentiviral ENV ISU
AIEKALKD

SEQ ID NO: 39 - protein, 8 aa, Artificial sequence
  fragement of lentiviral ENV ISU
AIEKFLKD

SEQ ID NO: 40 - protein, 8 aa, Artificial sequence
  fragement of lentiviral ENV ISU
AIEKGLKD

SEQ ID NO: 41 - protein, 8 aa, Artificial sequence
  fragement of lentiviral ENV ISU
AIEKLLKD

SEQ ID NO: 42 - protein, 8 aa, Artificial sequence
  fragement of lentiviral ENV ISU
AIEKRLKD

SEQ ID NO: 43 - protein, 8 aa, Artificial sequence
  fragement of lentiviral ENV ISU
AIEKYAKD

SEQ ID NO: 44 - protein, 8 aa, Artificial sequence
  fragement of lentiviral ENV ISU
AIEKYFKD

SEQ ID NO: 45 - protein, 8 aa, Artificial sequence
  fragement of lentiviral ENV ISU
AIEKYGKD

SEQ ID NO: 46 - protein, 8 aa, Artificial sequence
  fragement of lentiviral ENV ISU
AIEKYRKD

SEQ ID NO: 47 - protein, 8 aa, Artificial sequence
  fragement of lentiviral ENV ISU
AIEKAAKD

SEQ ID NO: 48 - protein, 8 aa, Artificial sequence
  fragement of lentiviral ENV ISU
AIEKAFKD

SEQ ID NO: 49 - protein, 8 aa, Artificial sequence
  fragement of lentiviral ENV ISU
AIEKAGKD

SEQ ID NO: 50 - protein, 8 aa, Artificial sequence
  fragement of lentiviral ENV ISU
AIEKARKD

SEQ ID NO: 51 - protein, 8 aa, Artificial sequence
  fragement of lentiviral ENV ISU
AIEKFAKD

SEQ ID NO: 52 - protein, 8 aa, Artificial sequence
  fragement of lentiviral ENV ISU
AIEKFFKD

SEQ ID NO: 53 - protein, 8 aa, Artificial sequence
  fragement of lentiviral ENV ISU
AIEKFGKD

SEQ ID NO: 54 - protein, 8 aa, Artificial sequence
  fragement of lentiviral ENV ISU
AIEKFRKD

SEQ ID NO: 55 - protein, 8 aa, Artificial sequence
  fragement of lentiviral ENV ISU
AIEKGAKD

SEQ ID NO: 56 - protein, 8 aa, Artificial sequence
  fragement of lentiviral ENV ISU
AIEKGFKD

SEQ ID NO: 57 - protein, 8 aa, Artificial sequence
  fragement of lentiviral ENV ISU
AIEKGGKD

SEQ ID NO: 58 - protein, 8 aa, Artificial sequence
  fragement of lentiviral ENV ISU
AIEKGRKD

SEQ ID NO: 59 - protein, 8 aa, Artificial sequence
  fragement of lentiviral ENV ISU
AIEKLAKD

SEQ ID NO: 60 - protein, 8 aa, Artificial sequence
  fragement of lentiviral ENV ISU
AIEKLFKD

SEQ ID NO: 61 - protein, 8 aa, Artificial sequence
  fragement of lentiviral ENV ISU
AIEKLGKD

SEQ ID NO: 62 - protein, 8 aa, Artificial sequence
  fragement of lentiviral ENV ISU
AIEKLRKD

SEQ ID NO: 63 - protein, 8 aa, Artificial sequence
  fragement of lentiviral ENV ISU
AIEKRAKD

SEQ ID NO: 64 - protein, 8 aa, Artificial sequence
  fragement of lentiviral ENV ISU
AIEKRFKD

SEQ ID NO: 65 - protein, 8 aa, Artificial sequence
  fragement of lentiviral ENV ISU
AIEKRGKD

SEQ ID NO: 66 - protein, 8 aa, Artificial Sequence
  fragement of lentiviral ENV ISU
AIEKRRKD

SEQ ID NO: 67 - protein, 8 aa, Artificial sequence
  fragement of lentiviral ENV ISU
AIERALKD

SEQ ID NO: 68 - protein, 8 aa, Artificial sequence
  fragement of lentiviral ENV ISU
AIERFLKD

SEQ ID NO: 69 - protein, 8 aa, Artificial sequence
  fragement of lentiviral ENV ISU
AIERGLKD

SEQ ID NO: 70 - protein, 8 aa, Artificial sequence
  fragement of lentiviral ENV ISU
AIERLLKD

SEQ ID NO: 71 - protein, 8 aa, Artificial sequence
  fragement of lentiviral ENV ISU
AIERRLKD

SEQ ID NO: 72 - protein, 8 aa, Artificial sequence
  fragement of lentiviral ENV ISU
AIERYAKD

SEQ ID NO: 73 - protein, 8 aa, Artificial sequence
  fragement of lentiviral ENV ISU
AIERYFKD

SEQ ID NO: 74 - protein, 8 aa, Artificial sequence
  fragement of lentiviral ENV ISU
AIERYGKD

SEQ ID NO: 75 - protein, 8 aa, Artificial sequence
  fragement of lentiviral ENV ISU
AIERYRKD

SEQ ID NO: 76 - protein, 8 aa, Artificial sequence
  fragement of lentiviral ENV ISU
AIERAAKD

SEQ ID NO: 77 - protein, 8 aa, Artificial sequence
  fragement of lentiviral ENV ISU
AIERAFKD

SEQ ID NO: 78 - protein, 8 aa, Artificial sequence
  fragement of lentiviral ENV ISU
AIERAGKD

SEQ ID NO: 79 - protein, 8 aa, Artificial sequence
  fragement of lentiviral ENV ISU
AIERARKD

SEQ ID NO: 80 - protein, 8 aa, Artificial sequence
  fragement of lentiviral ENV ISU
AIERFAKD

SEQ ID NO: 81 - protein, 8 aa, Artificial sequence
  fragement of lentiviral ENV ISU
AIERFFKD

SEQ ID NO: 82 - protein, 8 aa, Artificial sequence
  fragement of lentiviral ENV ISU
AIERFGKD

SEQ ID NO: 83 - protein, 8 aa, Artificial sequence
  fragement of lentiviral ENV ISU
AIERFRKD

SEQ ID NO: 84 - protein, 8 aa, Artificial sequence
  fragement of lentiviral ENV ISU
AIERGAKD

SEQ ID NO: 85 - protein, 8 aa, Artificial sequence
  fragement of lentiviral ENV ISU
AIERGFKD

SEQ ID NO: 86 - protein, 8 aa, Artificial sequence
  fragement of lentiviral ENV ISU
AIERGGKD

SEQ ID NO: 87 - protein, 8 aa, Artificial sequence
  fragement of lentiviral ENV ISU
AIERGRKD

SEQ ID NO: 88 - protein, 8 aa, Artificial sequence
  fragement of lentiviral ENV ISU
AIERLAKD

SEQ ID NO: 89 - protein, 8 aa, Artificial sequence
  fragement of lentiviral ENV ISU
AIERLFKD

SEQ ID NO: 90 - protein, 8 aa, Artificial sequence
  fragement of lentiviral ENV ISU
AIERLGKD

SEQ ID NO: 91 - protein, 8 aa, Artificial sequence
  fragement of lentiviral ENV ISU
AIERLRKD

SEQ ID NO: 92 - protein, 8 aa, Artificial sequence
  fragement of lentiviral ENV ISU
AIERRAKD

SEQ ID NO: 93 - protein, 8 aa, Artificial sequence
  fragement of lentiviral ENV ISU
AIERRFKD

SEQ ID NO: 94 - protein, 8 aa, Artificial sequence
  fragement of lentiviral ENV ISU
AIERRGKD

SEQ ID NO: 95 - protein, 8 aa, Artificial Sequence
  fragement of lentiviral ENV ISU
AIERRRKD

SEQ ID NO: 96 - protein, 49 aa, Artificial Sequence
  fragment of HIV1 ENV ISU
SGIVQQQSNLLRAIQARQHMLQLTVWGIKQLQARVLAVERALKDQQLLG

SEQ ID NO: 97 - protein, 49 aa, Artificial sequence
  fragment of HIV1 ENV ISU
SGIVQQQSNLLRAIQARQHMLQLTVWGIKQLQARVLAVERFLKDQQLLG

SEQ ID NO: 98 - protein, 49 aa, Artificial sequence
  fragment of HIV1 ENV ISU
SGIVQQQSNLLRAIQARQHMLQLTVWGIKQLQARVLAVERGLKDQQLLG

SEQ ID NO: 99 - protein, 49 aa, Artificial sequence
  fragment of HIV1 ENV ISU
SGIVQQQSNLLRAIQARQHMLQLTVWGIKQLQARVLAVERLLKDQQLLG

SEQ ID NO: 100 - protein, 49 aa, Artificial sequence
  fragment of HIV1 ENV ISU
SGIVQQQSNLLRAIQARQHMLQLTVWGIKQLQARVLAVERRLKDQQLLG

SEQ ID NO: 101 - protein, 49 aa, Artificial sequence
  fragment of HIV1 ENV ISU
SGIVQQQSNLLRAIQARQHMLQLTVWGIKQLQARVLAVERYAKDQQLLG

SEQ ID NO: 102 - protein, 49 aa, Artificial sequence
  fragment of HIV1 ENV ISU
SGIVQQQSNLLRAIQARQHMLQLTVWGIKQLQARVLAVERYFKDQQLLG

SEQ ID NO: 103 - protein, 49 aa, Artificial sequence
  fragment of HIV1 ENV ISU
SGIVQQQSNLLRAIQARQHMLQLTVWGIKQLQARVLAVERYGKDQQLLG

SEQ ID NO: 104 - protein, 49 aa, Artificial sequence
  fragment of HIV1 ENV ISU
SGIVQQQSNLLRAIQARQHMLQLTVWGIKQLQARVLAVERYRKDQQLLG

SEQ ID NO: 105 - protein, 49 aa, Artificial sequence
  fragment of HIV1 ENV ISU
SGIVQQQSNLLRAIQARQHMLQLTVWGIKQLQARVLAVERAAKDQQLLG

SEQ ID NO: 106 - protein, 49 aa, Artificial sequence
  fragment of HIV1 ENV ISU
SGIVQQQSNLLRAIQARQHMLQLTVWGIKQLQARVLAVERAFKDQQLLG

SEQ ID NO: 107 - protein, 49 aa, Artificial sequence
  fragment of HIV1 ENV ISU
SGIVQQQSNLLRAIQARQHMLQLTVWGIKQLQARVLAVERAGKDQQLLG

SEQ ID NO: 108 - protein, 49 aa, Artificial sequence
  fragment of HIV1 ENV ISU
SGIVQQQSNLLRAIQARQHMLQLTVWGIKQLQARVLAVERARKDQQLLG

SEQ ID NO: 109 - protein, 49 aa, Artificial sequence
  fragment of HIV1 ENV ISU
SGIVQQQSNLLRAIQARQHMLQLTVWGIKQLQARVLAVERFAKDQQLLG

SEQ ID NO: 110 - protein, 49 aa, Artificial sequence
  fragment of HIV1 ENV ISU
SGIVQQQSNLLRAIQARQHMLQLTVWGIKQLQARVLAVERFFKDQQLLG

SEQ ID NO: 111 - protein, 49 aa, Artificial sequence
  fragment of HIV1 ENV ISU
SGIVQQQSNLLRAIQARQHMLQLTVWGIKQLQARVLAVERFGKDQQLLG

SEQ ID NO: 112 - protein, 49 aa, Artificial sequence
  fragment of HIV1 ENV ISU
SGIVQQQSNLLRAIQARQHMLQLTVWGIKQLQARVLAVERFRKDQQLLG

SEQ ID NO: 113 - protein, 49 aa, Artificial sequence
  fragment of HIV1 ENV ISU
SGIVQQQSNLLRAIQARQHMLQLTVWGIKQLQARVLAVERGAKDQQLLG

SEQ ID NO: 114 - protein, 49 aa, Artificial sequence
  fragment of HIV1 ENV ISU
SGIVQQQSNLLRAIQARQHMLQLTVWGIKQLQARVLAVERGFKDQQLLG

SEQ ID NO: 115 - protein, 49 aa, Artificial sequence
  fragment of HIV1 ENV ISU
SGIVQQQSNLLRAIQARQHMLQLTVWGIKQLQARVLAVERGGKDQQLLG

SEQ ID NO: 116 - protein, 49 aa, Artificial sequence
  fragment of HIV1 ENV ISU
SGIVQQQSNLLRAIQARQHMLQLTVWGIKQLQARVLAVERGRKDQQLLG

SEQ ID NO: 117 - protein, 49 aa, Artificial sequence
  fragment of HIV1 ENV ISU
SGIVQQQSNLLRAIQARQHMLQLTVWGIKQLQARVLAVERLAKDQQLLG

SEQ ID NO: 118 - protein, 49 aa, Artificial sequence
  fragment of HIV1 ENV ISU
SGIVQQQSNLLRAIQARQHMLQLTVWGIKQLQARVLAVERLFKDQQLLG

SEQ ID NO: 119 - protein, 49 aa, Artificial sequence
  fragment of HIV1 ENV ISU
SGIVQQQSNLLRAIQARQHMLQLTVWGIKQLQARVLAVERLGKDQQLLG

SEQ ID NO: 120 - protein, 49 aa, Artificial sequence
  fragment of HIV1 ENV ISU
SGIVQQQSNLLRAIQARQHMLQLTVWGIKQLQARVLAVERLRKDQQLLG

SEQ ID NO: 121 - protein, 49 aa, Artificial sequence
  fragment of HIV1 ENV ISU
SGIVQQQSNLLRAIQARQHMLQLTVWGIKQLQARVLAVERRAKDQQLLG

SEQ ID NO: 122 - protein, 49 aa, Artificial sequence
  fragment of HIV1 ENV ISU
SGIVQQQSNLLRAIQARQHMLQLTVWGIKQLQARVLAVERRFKDQQLLG

SEQ ID NO: 123 - protein, 49 aa, Artificial sequence
  fragment of HIV1 ENV ISU
SGIVQQQSNLLRAIQARQHMLQLTVWGIKQLQARVLAVERRGKDQQLLG

SEQ ID NO: 124 - protein, 49 aa, Artificial sequence
  fragment of HIV1 ENV ISU
SGIVQQQSNLLRAIQARQHMLQLTVWGIKQLQARVLAVERRRKDQQLLG

SEQ ID NO: 125 - protein, 57 aa, Artificial sequence
  fragment of HIV2 ENV ISU
AGIVQQQQQLLDVVKRQQEMLRLTVWGTKNLQARVTAIEKALKDQAQLNSWGCAFRQ

SEQ ID NO: 126 - protein, 57 aa, Artificial sequence
  fragment of HIV2 ENV ISU
AGIVQQQQQLLDVVKRQQEMLRLTVWGTKNLQARVTAIEKFLKDQAQLNSWGCAFRQ

SEQ ID NO: 127 - protein, 57 aa, Artificial sequence
  fragment of HIV2 ENV ISU
AGIVQQQQQLLDVVKRQQEMLRLTVWGTKNLQARVTAIEKGLKDQAQLNSWGCAFRQ

SEQ ID NO: 128 - protein, 57 aa, Artificial sequence
  fragment of HIV2 ENV ISU
AGIVQQQQQLLDVVKRQQEMLRLTVWGTKNLQARVTAIEKLLKDQAQLNSWGCAFRQ

SEQ ID NO: 129 - protein, 57 aa, Artificial sequence
  fragment of HIV2 ENV ISU
AGIVQQQQQLLDVVKRQQEMLRLTVWGTKNLQARVTAIEKRLKDQAQLNSWGCAFRQ

SEQ ID NO: 130 - protein, 57 aa, Artificial sequence
  fragment of HIV2 ENV ISU
AGIVQQQQQLLDVVKRQQEMLRLTVWGTKNLQARVTAIEKYAKDQAQLNSWGCAFRQ

SEQ ID NO: 131 - protein, 57 aa, Artificial sequence
  fragment of HIV2 ENV ISU
AGIVQQQQQLLDVVKRQQEMLRLTVWGTKNLQARVTAIEKYFKDQAQLNSWGCAFRQ

SEQ ID NO: 132 - protein, 57 aa, Artificial sequence
  fragment of HIV2 ENV ISU
AGIVQQQQQLLDVVKRQQEMLRLTVWGTKNLQARVTAIEKYGKDQAQLNSWGCAFRQ

SEQ ID NO: 133 - protein, 57 aa, Artificial sequence
  fragment of HIV2 ENV ISU
AGIVQQQQQLLDVVKRQQEMLRLTVWGTKNLQARVTAIEKYRKDQAQLNSWGCAFRQ

SEQ ID NO: 134 - protein, 57 aa, Artificial sequence
  fragment of HIV2 ENV ISU
AGIVQQQQQLLDVVKRQQEMLRLTVWGTKNLQARVTAIEKAAKDQAQLNSWGCAFRQ

SEQ ID NO: 135 - protein, 57 aa, Artificial sequence
  fragment of HIV2 ENV ISU
AGIVQQQQQLLDVVKRQQEMLRLTVWGTKNLQARVTAIEKAFKDQAQLNSWGCAFRQ

SEQ ID NO: 136 - protein, 57 aa, Artificial sequence
  fragment of HIV2 ENV ISU
AGIVQQQQQLLDVVKRQQEMLRLTVWGTKNLQARVTAIEKAGKDQAQLNSWGCAFRQ

SEQ ID NO: 137 - protein, 57 aa, Artificial sequence
  fragment of HIV2 ENV ISU
AGIVQQQQQLLDVVKRQQEMLRLTVWGTKNLQARVTAIEKARKDQAQLNSWGCAFRQ

SEQ ID NO: 138 - protein, 57 aa, Artificial sequence
  fragment of HIV2 ENV ISU
AGIVQQQQQLLDVVKRQQEMLRLTVWGTKNLQARVTAIEKFAKDQAQLNSWGCAFRQ

SEQ ID NO: 139 - protein, 57 aa, Artificial sequence
  fragment of HIV2 ENV ISU
AGIVQQQQQLLDVVKRQQEMLRLTVWGTKNLQARVTAIEKFFKDQAQLNSWGCAFRQ

SEQ ID NO: 140 - protein, 57 aa, Artificial sequence
  fragment of HIV2 ENV ISU
AGIVQQQQQLLDVVKRQQEMLRLTVWGTKNLQARVTAIEKFGKDQAQLNSWGCAFRQ

SEQ ID NO: 141 - protein, 57 aa, Artificial sequence
  fragment of HIV2 ENV ISU
AGIVQQQQQLLDVVKRQQEMLRLTVWGTKNLQARVTAIEKFRKDQAQLNSWGCAFRQ

SEQ ID NO: 142 - protein, 57 aa, Artificial sequence
  fragment of HIV2 ENV ISU
AGIVQQQQQLLDVVKRQQEMLRLTVWGTKNLQARVTAIEKGAKDQAQLNSWGCAFRQ

SEQ ID NO: 143 - protein, 57 aa, Artificial sequence
  fragment of HIV2 ENV ISU
AGIVQQQQQLLDVVKRQQEMLRLTVWGTKNLQARVTAIEKGFKDQAQLNSWGCAFRQ

SEQ ID NO: 144 - protein, 57 aa, Artificial sequence
  fragment of HIV2 ENV ISU
AGIVQQQQQLLDVVKRQQEMLRLTVWGTKNLQARVTAIEKGGKDQAQLNSWGCAFRQ

SEQ ID NO: 145 - protein, 57 aa, Artificial sequence
  fragment of HIV2 ENV ISU
AGIVQQQQQLLDVVKRQQEMLRLTVWGTKNLQARVTAIEKGRKDQAQLNSWGCAFRQ

SEQ ID NO: 146 - protein, 57 aa, Artificial sequence
  fragment of HIV2 ENV ISU
AGIVQQQQQLLDVVKRQQEMLRLTVWGTKNLQARVTAIEKLAKDQAQLNSWGCAFRQ

SEQ ID NO: 147 - protein, 57 aa, Artificial sequence
  fragment of HIV2 ENV ISU
AGIVQQQQQLLDVVKRQQEMLRLTVWGTKNLQARVTAIEKLFKDQAQLNSWGCAFRQ

SEQ ID NO: 148 - protein, 57 aa, Artificial sequence
  fragment of HIV2 ENV ISU
AGIVQQQQQLLDVVKRQQEMLRLTVWGTKNLQARVTAIEKLGKDQAQLNSWGCAFRQ

SEQ ID NO: 149 - protein, 57 aa, Artificial sequence
  fragment of HIV2 ENV ISU
AGIVQQQQQLLDVVKRQQEMLRLTVWGTKNLQARVTAIEKLRKDQAQLNSWGCAFRQ

SEQ ID NO: 150 - protein, 57 aa, Artificial sequence
  fragment of HIV2 ENV ISU
AGIVQQQQQLLDVVKRQQEMLRLTVWGTKNLQARVTAIEKRAKDQAQLNSWGCAFRQ

SEQ ID NO: 151 - protein, 57 aa, Artificial sequence
  fragment of HIV2 ENV ISU
AGIVQQQQQLLDVVKRQQEMLRLTVWGTKNLQARVTAIEKRFKDQAQLNSWGCAFRQ

SEQ ID NO: 152 - protein, 57 aa, Artificial sequence
  fragment of HIV2 ENV ISU
AGIVQQQQQLLDVVKRQQEMLRLTVWGTKNLQARVTAIEKRGKDQAQLNSWGCAFRQ

SEQ ID NO: 153 - protein, 57 aa, Artificial Sequence
  fragment of HIV2 ENV ISU
AGIVQQQQQLLDVVKRQQEMLRLTVWGTKNLQARVTAIEKRRKDQAQLNSWGCAFRQ

SEQ ID NO: 154 - protein, 57 aa, Artificial sequence
  fragment of HIV2 ENV ISU
AGIVQQQQQLLDVVKRQQELLRLTVWGTKNLQARVTAIEKALQDQARLNSWGCAFRQ

SEQ ID NO: 155 - protein, 57 aa, Artificial sequence
  fragment of HIV2 ENV ISU
AGIVQQQQQLLDVVKRQQELLRLTVWGTKNLQARVTAIEKFLQDQARLNSWGCAFRQ

SEQ ID NO: 156 - protein, 57 aa, Artificial sequence
  fragment of HIV2 ENV ISU
AGIVQQQQQLLDVVKRQQELLRLTVWGTKNLQARVTAIEKGLQDQARLNSWGCAFRQ

SEQ ID NO: 157 - protein, 57 aa, Artificial sequence
  fragment of HIV2 ENV ISU
AGIVQQQQQLLDVVKRQQELLRLTVWGTKNLQARVTAIEKLLQDQARLNSWGCAFRQ

SEQ ID NO: 158 - protein, 57 aa, Artificial sequence
  fragment of HIV2 ENV ISU
AGIVQQQQQLLDVVKRQQELLRLTVWGTKNLQARVTAIEKRLQDQARLNSWGCAFRQ

SEQ ID NO: 159 - protein, 57 aa, Artificial sequence
  fragment of HIV2 ENV ISU
AGIVQQQQQLLDVVKRQQELLRLTVWGTKNLQARVTAIEKYAQDQARLNSWGCAFRQ

SEQ ID NO: 160 - protein, 57 aa, Artificial sequence
  fragment of HIV2 ENV ISU
AGIVQQQQQLLDVVKRQQELLRLTVWGTKNLQARVTAIEKYFQDQARLNSWGCAFRQ

SEQ ID NO: 161 - protein, 57 aa, Artificial sequence
  fragment of HIV2 ENV ISU
AGIVQQQQQLLDVVKRQQELLRLTVWGTKNLQARVTAIEKYGQDQARLNSWGCAFRQ

SEQ ID NO: 162 - protein, 57 aa, Artificial sequence
  fragment of HIV2 ENV ISU
AGIVQQQQQLLDVVKRQQELLRLTVWGTKNLQARVTAIEKYRQDQARLNSWGCAFRQ

SEQ ID NO: 163 - protein, 57 aa, Artificial sequence
  fragment of HIV2 ENV ISU
AGIVQQQQQLLDVVKRQQELLRLTVWGTKNLQARVTAIEKAAQDQARLNSWGCAFRQ

SEQ ID NO: 164 - protein, 57 aa, Artificial sequence
  fragment of HIV2 ENV ISU
AGIVQQQQQLLDVVKRQQELLRLTVWGTKNLQARVTAIEKAFQDQARLNSWGCAFRQ

SEQ ID NO: 165 - protein, 57 aa, Artificial sequence
  fragment of HIV2 ENV ISU
AGIVQQQQQLLDVVKRQQELLRLTVWGTKNLQARVTAIEKAGQDQARLNSWGCAFRQ

SEQ ID NO: 166 - protein, 57 aa, Artificial sequence
  fragment of HIV2 ENV ISU
AGIVQQQQQLLDVVKRQQELLRLTVWGTKNLQARVTAIEKARQDQARLNSWGCAFRQ

SEQ ID NO: 167 - protein, 57 aa, Artificial sequence
  fragment of HIV2 ENV ISU
AGIVQQQQQLLDVVKRQQELLRLTVWGTKNLQARVTAIEKFAQDQARLNSWGCAFRQ

SEQ ID NO: 168 - protein, 57 aa, Artificial sequence
  fragment of HIV2 ENV ISU
AGIVQQQQQLLDVVKRQQELLRLTVWGTKNLQARVTAIEKFFQDQARLNSWGCAFRQ

SEQ ID NO: 169 - protein, 57 aa, Artificial sequence
  fragment of HIV2 ENV ISU
AGIVQQQQQLLDVVKRQQELLRLTVWGTKNLQARVTAIEKFGQDQARLNSWGCAFRQ

SEQ ID NO: 170 - protein, 57 aa, Artificial sequence
  fragment of HIV2 ENV ISU
AGIVQQQQQLLDVVKRQQELLRLTVWGTKNLQARVTAIEKFRQDQARLNSWGCAFRQ

SEQ ID NO: 171 - protein, 57 aa, Artificial sequence
  fragment of HIV2 ENV ISU
AGIVQQQQQLLDVVKRQQELLRLTVWGTKNLQARVTAIEKGAQDQARLNSWGCAFRQ

SEQ ID NO: 172 - protein, 57 aa, Artificial sequence
  fragment of HIV2 ENV ISU
AGIVQQQQQLLDVVKRQQELLRLTVWGTKNLQARVTAIEKGFQDQARLNSWGCAFRQ

SEQ ID NO: 173 - protein, 57 aa, Artificial sequence
  fragment of HIV2 ENV ISU
AGIVQQQQQLLDVVKRQQELLRLTVWGTKNLQARVTAIEKGGQDQARLNSWGCAFRQ

SEQ ID NO: 174 - protein, 57 aa, Artificial sequence
  fragment of HIV2 ENV ISU
AGIVQQQQQLLDVVKRQQELLRLTVWGTKNLQARVTAIEKGRQDQARLNSWGCAFRQ

SEQ ID NO: 175 - protein, 57 aa, Artificial sequence
  fragment of HIV2 ENV ISU
AGIVQQQQQLLDVVKRQQELLRLTVWGTKNLQARVTAIEKLAQDQARLNSWGCAFRQ

SEQ ID NO: 176 - protein, 57 aa, Artificial sequence
  fragment of HIV2 ENV ISU
AGIVQQQQQLLDVVKRQQELLRLTVWGTKNLQARVTAIEKLFQDQARLNSWGCAFRQ

SEQ ID NO: 177 - protein, 57 aa, Artificial sequence
  fragment of HIV2 ENV ISU
AGIVQQQQQLLDVVKRQQELLRLTVWGTKNLQARVTAIEKLGQDQARLNSWGCAFRQ

SEQ ID NO: 178 - protein, 57 aa, Artificial sequence
  fragment of HIV2 ENV ISU
AGIVQQQQQLLDVVKRQQELLRLTVWGTKNLQARVTAIEKLRQDQARLNSWGCAFRQ

SEQ ID NO: 179 - protein, 57 aa, Artificial sequence
  fragment of HIV2 ENV ISU
AGIVQQQQQLLDVVKRQQELLRLTVWGTKNLQARVTAIEKRAQDQARLNSWGCAFRQ

SEQ ID NO: 180 - protein, 57 aa, Artificial sequence
  fragment of HIV2 ENV ISU
AGIVQQQQQLLDVVKRQQELLRLTVWGTKNLQARVTAIEKRFQDQARLNSWGCAFRQ

SEQ ID NO: 181 - protein, 57 aa, Artificial sequence
  fragment of HIV2 ENV ISU
AGIVQQQQQLLDVVKRQQELLRLTVWGTKNLQARVTAIEKRGQDQARLNSWGCAFRQ

SEQ ID NO: 182 - protein, 57 aa, Artificial Sequence
  fragment of HIV2 ENV ISU
AGIVQQQQQLLDVVKRQQELLRLTVWGTKNLQARVTAIEKRRQDQARLNSWGCAFRQ

SEQ ID NO: 183 - protein, 57 aa, Artificial sequence
  fragment of SIV ENV ISU
AGIVQQQQQLLDVVKRQQELLRLTVWGTKNLQTRVTAIEKALKDQAQLNAWGCAFRQ

SEQ ID NO: 184 - protein, 57 aa, Artificial sequence
  fragment of SIV ENV ISU
AGIVQQQQQLLDVVKRQQELLRLTVWGTKNLQTRVTAIEKFLKDQAQLNAWGCAFRQ

SEQ ID NO: 185 - protein, 57 aa, Artificial sequence
  fragment of SIV ENV ISU
AGIVQQQQQLLDVVKRQQELLRLTVWGTKNLQTRVTAIEKGLKDQAQLNAWGCAFRQ

SEQ ID NO: 186 - protein, 57 aa, Artificial sequence
  fragment of SIV ENV ISU
AGIVQQQQQLLDVVKRQQELLRLTVWGTKNLQTRVTAIEKLLKDQAQLNAWGCAFRQ

SEQ ID NO: 187 - protein, 57 aa, Artificial sequence
  fragment of SIV ENV ISU
AGIVQQQQQLLDVVKRQQELLRLTVWGTKNLQTRVTAIEKRLKDQAQLNAWGCAFRQ

SEQ ID NO: 188 - protein, 57 aa, Artificial sequence
  fragment of SIV ENV ISU
AGIVQQQQQLLDVVKRQQELLRLTVWGTKNLQTRVTAIEKYAKDQAQLNAWGCAFRQ

SEQ ID NO: 189 - protein, 57 aa, Artificial sequence
  fragment of SIV ENV ISU
AGIVQQQQQLLDVVKRQQELLRLTVWGTKNLQTRVTAIEKYFKDQAQLNAWGCAFRQ

SEQ ID NO: 190 - protein, 57 aa, Artificial sequence
  fragment of SIV ENV ISU
AGIVQQQQQLLDVVKRQQELLRLTVWGTKNLQTRVTAIEKYGKDQAQLNAWGCAFRQ

SEQ ID NO: 191 - protein, 57 aa, Artificial sequence
  fragment of SIV ENV ISU
AGIVQQQQQLLDVVKRQQELLRLTVWGTKNLQTRVTAIEKYRKDQAQLNAWGCAFRQ

SEQ ID NO: 192 - protein, 57 aa, Artificial sequence
  fragment of SIV ENV ISU
AGIVQQQQQLLDVVKRQQELLRLTVWGTKNLQTRVTAIEKAAKDQAQLNAWGCAFRQ

SEQ ID NO: 193 - protein, 57 aa, Artificial sequence
  fragment of SIV ENV ISU
AGIVQQQQQLLDVVKRQQELLRLTVWGTKNLQTRVTAIEKAFKDQAQLNAWGCAFRQ

SEQ ID NO: 194 - protein, 57 aa, Artificial sequence
  fragment of SIV ENV ISU
AGIVQQQQQLLDVVKRQQELLRLTVWGTKNLQTRVTAIEKAGKDQAQLNAWGCAFRQ

SEQ ID NO: 195 - protein, 57 aa, Artificial sequence
  fragment of SIV ENV ISU
AGIVQQQQQLLDVVKRQQELLRLTVWGTKNLQTRVTAIEKARKDQAQLNAWGCAFRQ

SEQ ID NO: 196 - protein, 57 aa, Artificial sequence
  fragment of SIV ENV ISU
AGIVQQQQQLLDVVKRQQELLRLTVWGTKNLQTRVTAIEKFAKDQAQLNAWGCAFRQ

SEQ ID NO: 197 - protein, 57 aa, Artificial sequence
  fragment of SIV ENV ISU
AGIVQQQQQLLDVVKRQQELLRLTVWGTKNLQTRVTAIEKFFKDQAQLNAWGCAFRQ

SEQ ID NO: 198 - protein, 57 aa, Artificial sequence
  fragment of SIV ENV ISU
AGIVQQQQQLLDVVKRQQELLRLTVWGTKNLQTRVTAIEKFGKDQAQLNAWGCAFRQ

SEQ ID NO: 199 - protein, 57 aa, Artificial sequence
  fragment of SIV ENV ISU
AGIVQQQQQLLDVVKRQQELLRLTVWGTKNLQTRVTAIEKFRKDQAQLNAWGCAFRQ

SEQ ID NO: 200 - protein, 57 aa, Artificial sequence
  fragment of SIV ENV ISU
AGIVQQQQQLLDVVKRQQELLRLTVWGTKNLQTRVTAIEKGAKDQAQLNAWGCAFRQ

SEQ ID NO: 201 - protein, 57 aa, Artificial sequence
  fragment of SIV ENV ISU
AGIVQQQQQLLDVVKRQQELLRLTVWGTKNLQTRVTAIEKGFKDQAQLNAWGCAFRQ

SEQ ID NO: 202 - protein, 57 aa, Artificial sequence
  fragment of SIV ENV ISU
AGIVQQQQQLLDVVKRQQELLRLTVWGTKNLQTRVTAIEKGGKDQAQLNAWGCAFRQ

SEQ ID NO: 203 - protein, 57 aa, Artificial sequence
  fragment of SIV ENV ISU
AGIVQQQQQLLDVVKRQQELLRLTVWGTKNLQTRVTAIEKGRKDQAQLNAWGCAFRQ

SEQ ID NO: 204 - protein, 57 aa, Artificial sequence
  fragment of SIV ENV ISU
AGIVQQQQQLLDVVKRQQELLRLTVWGTKNLQTRVTAIEKLAKDQAQLNAWGCAFRQ

SEQ ID NO: 205 - protein, 57 aa, Artificial sequence
  fragment of SIV ENV ISU
AGIVQQQQQLLDVVKRQQELLRLTVWGTKNLQTRVTAIEKLFKDQAQLNAWGCAFRQ

SEQ ID NO: 206 - protein, 57 aa, Artificial sequence
  fragment of SIV ENV ISU
AGIVQQQQQLLDVVKRQQELLRLTVWGTKNLQTRVTAIEKLGKDQAQLNAWGCAFRQ

SEQ ID NO: 207 - protein, 57 aa, Artificial sequence
  fragment of SIV ENV ISU
AGIVQQQQQLLDVVKRQQELLRLTVWGTKNLQTRVTAIEKLRKDQAQLNAWGCAFRQ

SEQ ID NO: 208 - protein, 57 aa, Artificial sequence
  fragment of SIV ENV ISU
AGIVQQQQQLLDVVKRQQELLRLTVWGTKNLQTRVTAIEKRAKDQAQLNAWGCAFRQ

SEQ ID NO: 209 - protein, 57 aa, Artificial sequence
  fragment of SIV ENV ISU
AGIVQQQQQLLDVVKRQQELLRLTVWGTKNLQTRVTAIEKRFKDQAQLNAWGCAFRQ

SEQ ID NO: 210 - protein, 57 aa, Artificial sequence
  fragment of SIV ENV ISU
AGIVQQQQQLLDVVKRQQELLRLTVWGTKNLQTRVTAIEKRGKDQAQLNAWGCAFRQ

SEQ ID NO: 211 - protein, 57 aa, Artificial Sequence
  fragment of SIV ENV ISU
AGIVQQQQQLLDVVKRQQELLRLTVWGTKNLQTRVTAIEKRRKDQAQLNAWGCAFRQ

SEQ ID NO: 212 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERALKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 213 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERFLKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 214 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERGLKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 215 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERLLKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 216 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRLKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 217 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERYAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 218 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERYFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 219 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERYGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 220 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERYRKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 221 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERAAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 222 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERAFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 223 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERAGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 224 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERARKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 225 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERFAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 226 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERFFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 227 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERFGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 228 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERFRKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 229 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERGAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 230 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERGFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 231 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERGGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 232 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERGRKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 233 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERLAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 234 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERLFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 235 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERLGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 236 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERLRKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 237 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRAKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 238 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRFKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 239 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRGKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 240 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRRKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 241 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERALKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 242 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERFLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 243 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERGLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 244 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERLLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 245 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERRLKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 246 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 247 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 248 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 249 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYRKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 250 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERAAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 251 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERAFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 252 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERAGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 253 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERARKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 254 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERFAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 255 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERFFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 256 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERFGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 257 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERFRKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 258 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERGAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 259 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERGFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 260 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERGGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 261 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERGRKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 262 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERLAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 263 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERLFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 264 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERLGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 265 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERLRKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 266 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERRAKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 267 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERRFKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 268 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERRGKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 269 - protein, 856 aa, Human immunodeficiency virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNNTLKQIDSKLREQFGNNKTIIFKQSSGGDPEIVTHSFNCGGEFFYCNSTQLFNSTWFNSTWSTKGSNNTEGSDTITLPCRIKQIINMWQEVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERRRKDQQLLGIWGCSGKLICTTAVPWNASWSNKSLEQIWNNMTWMEWDREINNYTSLIHSLIEESQNQQEKNEQELLELDKWASLWNWFNITNWLWYIKLFIMIVGGLVGLRIVFAVLSVVNRVRQGYSPLSFQTHLPIPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGAYRAIRHIPRRIRQGLERILL

SEQ ID NO: 270 - protein, 32 aa, Artificial Sequence
  fragemnt of lentiviral ENV protein
  misc_feature (1)..(1): Xaa can be any naturally occurring amino acid
  misc_feature (4)..(5): Xaa can be any naturally occurring amino acid
  misc_feature (7)..(8): Xaa can be any naturally occurring amino acid
  MISC_FEATURE (12)..(12): Xaa = A or S
  misc_feature (13)..(15): Xaa can be any naturally occurring amino acid
  misc_feature (18)..(18): Xaa can be any naturally occurring amino acid
  misc_feature (20)..(20): Xaa can be any naturally occurring amino acid
  misc_feature (24)..(24): Xaa can be any naturally occurring amino acid
  MISC_FEATURE (25)..(29): Xaa = no or any amino acid
  MISC_FEATURE (30)..(30): Xaa = N or S
  MISC_FEATURE (31)..(31): Xaa = E, D, N or A
  MISC_FEATURE (32)..(32): Xaa = S or T
XDQXXLXXWGCXXXXCVXTXVPWXXXXXXXXX

SEQ ID NO: 271 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNASLEQIWNNMTWMEWDREINNYTSLIHSLIEESQNQQEKNEQEL

SEQ ID NO: 272 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNGSLEQIWNNMTWMEWDREINNYTSLIHSLIEESQNQQEKNEQEL

SEQ ID NO: 273 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNSSLEQIWNNMTWMEWDREINNYTSLIHSLIEESQNQQEKNEQEL

SEQ ID NO: 274 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPDNASWSNKSLEQIWNNMTWMEWDREINNYTSLIHSLIEESQNQQEKNEQEL

SEQ ID NO: 275 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPANASWSNKSLEQIWNNMTWMEWDREINNYTSLIHSLIEESQNQQEKNEQEL

SEQ ID NO: 276 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPNNASWSNKSLEQIWNNMTWMEWDREINNYTSLIHSLIEESQNQQEKNEQEL

SEQ ID NO: 277 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNKDLEQIWNNMTWMEWDREINNYTSLIHSLIEESQNQQEKNEQEL

SEQ ID NO: 278 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNKALEQIWNNMTWMEWDREINNYTSLIHSLIEESQNQQEKNEQEL

SEQ ID NO: 279 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNKNLEQIWNNMTWMEWDREINNYTSLIHSLIEESQNQQEKNEQEL

SEQ ID NO: 280 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNYSLEQIWNNMTWMEWDREINNYTSLIHSLIEESQNQQEKNEQEL

SEQ ID NO: 281 - protein, 115 aa, Artificial sequence
  derived from lentiviral ENV ISU
SGIVQQQNNLLRAIEAQQHLLQLTVWGIKQLQARILAVEARLKDQQLLGIWGCSGKLICTTAVPWNASWSNASLEQIWNNMTWMEWDREINNYTSLIHSLIEESQNQQEKNEQEL

SEQ ID NO: 282 - protein, 115 aa, Artificial sequence
  derived from lentiviral ENV ISU
SGIVQQQNNLLRAIEAQQHLLQLTVWGIKQLQARILAVERRLKDQQLLGIWGCSGKLICTTAVPWNASWSNAALEQIWNNMTWMEWDREINNYTSLIHSLIEESQNQQEKNEQEL

SEQ ID NO: 283 - protein, 115 aa, Artificial Sequence
  derived from lentiviral ENV ISU
SGIVQQQNNLLRAIEAQQHLLQLTVWGIKQLQARILAVERRLKDQQLLGIWGCSGKLICTTAVPANASWSNAALEQIWNNMTWMEWDREINNYTSLIHSLIEESQNQQEKNEQEL

SEQ ID NO: 284 - protein, 861 aa, Human immunodeficiency virus type 1; identical to SEQ ID NO: 216

SEQ ID NO: 285 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRLKDQQLLGIWGCSGKLICTTAVPWNASWSNASLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 286 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRLKDQQLLGIWGCSGKLICTTAVPWNASWSNGSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 287 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERRLKDQQLLGIWGCSGKLICTTAVPWNASWSNSSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 288 - protein, 861 aa, Human immunodeficiency virus type 1; identical to SEQ ID NO: 214

SEQ ID NO: 289 - protein, 861 aa, Human immunodeficiency virus type 1; identical to SEQ ID NO: 215

SEQ ID NO: 290 - protein, 861 aa, Human immunodeficiency virus type 1; identical to SEQ ID NO: 212

SEQ ID NO: 291 - protein, 861 aa, Human immunodeficiency virus type 1; identical to SEQ ID NO: 213

SEQ ID NO: 292 - protein, 861 aa, Human immunodeficiency virus type 1; identical to SEQ ID NO: 220

SEQ ID NO: 293 - protein, 881 aa, Simian immunodeficiency virus
  misc_feature (736)..(736): Xaa can be any naturally occurring amino acid
MGCLGNQLLIAILLLSVYGIYCTQYVTVFYGVPAWRNATIPLFCATKNRDTWGTTQCLPDNGDYSELALNVTESFDAWENTVTEQAIEDVWQLFETSIKPCVKLSPLCITMRCNKSETDRWGLTKSSTTITTAAPTSAPVSEKIDMVNETSSCIAQNNCTGLEQEQMISCKFTMTGLKRDKTKEYNETWYSTDLVCEQGNSTDNESRCYMNHCNTSVIQESCDKHYWDTIRFRYCAPPGYALLRCNDTNYSGFMPKCSKVVVSSCTRMMETQTSTWFGFNGTRAENRTYIYWHGRDNRTIISLNKYYNLTMKCRRPGNKTVLPVTIMSGLVFHSQPINDRPKQAWCWFGGKWKDAIKEVKQTIVKHPRYTGTNNTDKINLTAPGGGDPEVTFMWTNCRGEFLYCKMNWFLNWVEDRDVTTQRPKERHRRNYVPCHIRQIINTWHKVGKNVYLPPREGDLTCNSTVTSLIANIDWTDGNQTSITMSAEVAELYRLELGDYKLVEITPIGLAPTDVKRYTTGGTSRNKRGVFVLGFLGFLATAGSAMGAASLTLTAQSRTLLAGIVQQQQQLLDVVKRQQELLRLTVWGTKNLQTRVTAIEKYRKDQAQLNAWGCAFRQVCHTTVPWPNASLTPDWNNDTWQEWERKVDFLEENITALLEEAQIQQEKNMYELQKLNSWDVFGNWFDLASWIKYIQYGIYVVVGVILLRIVIYIVQMLAKLRQGYRPVFSSPPSYFQXTHTQQDPALPTREGKEGDGGEGGGNSSWPWQIEYIHFLIRQLIRLLTWLFSNCRTLLSRAYQILQPILQRLSATLRRVREVLRTELTYLQYGWSYFHEAVQAGWRSATETLAGAWRDLWETLRRGGRWILAIPRRIRQGLELTLL

SEQ ID NO: 294 - protein, 860 aa, Human immunodeficiency virus type 2
MEPGRNQLFVVILLTSACLVYCSQYVTVFYGIPAWKNASIPLFCATKNRDTWGTIQCLPDNDDYQEIILNVTEAFDAWNNTVTEQAVEDVWHLFETSIKPCVKLTPLCVAMNCSRVQGNTTTPNPRTSSSTTSRPPTSAASIINETSNCIENNTCAGLGYEEMMQCEFNMKGLEQDKKRRYKDTWYLEDVVCDNTTAGTCYMRHCNTSIIKESCDKHYWDAMRFRYCAPPGFALLRCNDTNYSGFEPKCTKVVAASCTRMMETQTSTWFGFNGTRAENRTYIYWHGRDNRTIISLNKYYNLTMRCKRPGNKTVLPITLMSGLVFHSQPINTRPRQAWCRFGGRWREAMQEVKQTLVQHPRYKGINDTGKINFTKPGAGSDPEVAFMWTNCRGEFLYCNMTWFLNWVEDKNQTRRNYCHIKQIINTWHKVGKNVYLPPREGELACESTVTSIIANIDIDKNRTHTNITFSAEVAELYRLELGDYKLIEITPIGFAPTDQRRYSSTPVRNKRGVFVLGFLGFLATAGSAMGARSLTLSAQSRTLLAGIVQQQQQLLDVVKRQQEMLRLTVWGTKNLQARVTAIEKYRKHQAQLNSWGCAFRQVCHTTVPWVNDSLSPDWKNMTWQEWEKQVRYLEANISQSLEEAQIQQEKNMYELQKLNSWDILGNWFDLTSWVKYIQYGVHIVVGIIALRIAIYVVQLLSRFRKGYRPVFSSPPGYLQQIHIHKDRGQPANEGTEEDVGGDSGYDLWPWPINYVQFLIHLLTRLLIGLYNICRDLLSKNSPTRRLISQSLTAIRDWLRLKAAQLQYGCEWIQEAFQAFARTTRETLAGAWGWLWEAARRIGRGILAVPRRIRQGAELALL

SEQ ID NO: 295 - DNA, 36 bp, Artificial sequence
  oligonucleotide for introducing mutation within the ISU of lentiviral ENV protein
acatggcccagccggcctctggtatagtgcagcagc

SEQ ID NO: 296 - DNA, 34 bp, Artificial sequence
  oligonucleotide for introducing mutation within the ISU of lentiviral ENV protein
gtatacgcgtttataattcttgttcattcttttc

SEQ ID NO: 297 - DNA, 35 bp, Artificial sequence
  oligonucleotide for introducing mutation within the ISU of lentiviral ENV protein
gtatacgcgtttacatgttattccaaatctgttcc

SEQ ID NO: 298 - DNA, 31 bp, Artificial sequence
  oligonucleotide for introducing mutation within the ISU of lentiviral ENV protein
gtatacgcgtttaagcattccaaggcacagc

SEQ ID NO: 299 - DNA, 33 bp, Artificial sequence
  oligonucleotide for introducing mutation within the ISU of lentiviral ENV protein
gtatacgcgtttatccagagcaaccccaaatcc

SEQ ID NO: 300 - DNA, 32 bp, Artificial sequence
  oligonucleotide for introducing mutation within the ISU of lentiviral ENV protein
gtatacgcgtttaccccaggagctgttgatcc

SEQ ID NO: 301 - DNA, 34 bp, Artificial sequence
  oligonucleotide for introducing mutation within the ISU of lentiviral ENV protein
gtatacgcgtttactttaggtatctttccacagc

SEQ ID NO: 302 - DNA, 34 bp, Artificial sequence
  oligonucleotide for introducing mutation within the ISU of lentiviral ENV protein
gtatacgcgtttaagccaggattcttgcctggag

SEQ ID NO: 303 - DNA, 31 bp, Artificial sequence
  oligonucleotide for introducing mutation within the ISU of lentiviral ENV protein
gtatacgcgtttactgcttgatgccccagac

SEQ ID NO: 304 - DNA, 26 bp, Artificial sequence
  oligonucleotide for introducing mutation within the ISU of lentiviral ENV protein
ctttccacagcccggattcttgcctg

SEQ ID NO: 305 - DNA, 26 bp, Artificial sequence
  oligonucleotide for introducing mutation within the ISU of lentiviral ENV protein
caggcaagaatccgggctgtggaaag

SEQ ID NO: 306 - DNA, 28 bp, Artificial sequence
  oligonucleotide for introducing mutation within the ISU of lentiviral ENV protein
gtatctttccacacgcaggattcttgcc

SEQ ID NO: 307 - DNA, 28 bp, Artificial sequence
  oligonucleotide for introducing mutation within the ISU of lentiviral ENV protein
ggcaagaatcctgcgtgtggaaagatac

SEQ ID NO: 308 - DNA, 34 bp, Artificial sequence
  oligonucleotide for introducing mutation within the ISU of lentiviral ENV protein
ctttaggtatctttccctagccaggattcttgcc

SEQ ID NO: 309 - DNA, 34 bp, Artificial sequence
  oligonucleotide for introducing mutation within the ISU of lentiviral ENV protein
ggcaagaatcctggctagggaaagatacctaaag

SEQ ID NO: 310 - DNA, 30 bp, Artificial sequence
  oligonucleotide for introducing mutation within the ISU of lentiviral ENV protein
cctttaggtatcttctcacagccaggattc

SEQ ID NO: 311 - DNA, 30 bp, Artificial sequence
  oligonucleotide for introducing mutation within the ISU of lentiviral ENV protein
gaatcctggctgtgagaagatacctaaagg

SEQ ID NO: 312 - DNA, 31 bp, Artificial sequence
  oligonucleotide for introducing mutation within the ISU of lentiviral ENV protein
gttgatcctttaggcgtctttccacagccag

SEQ ID NO: 313 - DNA, 31 bp, Artificial sequence
  oligonucleotide for introducing mutation within the ISU of lentiviral ENV protein
ctggctgtggaaagacgcctaaaggatcaac

SEQ ID NO: 314 - DNA, 35 bp, Artificial sequence
  oligonucleotide for introducing mutation within the ISU of lentiviral ENV protein
ggagctgttgatcctttcggtatctttccacagcc

SEQ ID NO: 315 - DNA, 35 bp, Artificial sequence
  oligonucleotide for introducing mutation within the ISU of lentiviral ENV protein
ggctgtggaaagataccgaaaggatcaacagctcc

SEQ ID NO: 316 - DNA, 30 bp, Artificial sequence
  oligonucleotide for introducing mutation within the ISU of lentiviral ENV protein
gagctgttgatcccttaggtatctttccac

SEQ ID NO: 317 - DNA, 30 bp, Artificial sequence
  oligonucleotide for introducing mutation within the ISU of lentiviral ENV protein
gtggaaagatacctaagggatcaacagctc

SEQ ID NO: 318 - DNA, 28 bp, Artificial sequence
  oligonucleotide for introducing mutation within the ISU of lentiviral ENV protein
aggagctgttgacgctttaggtatcttt

SEQ ID NO: 319 - DNA, 28 bp, Artificial sequence
  oligonucleotide for introducing mutation within the ISU of lentiviral ENV protein
aaagatacctaaagcgtcaacagctcct

SEQ ID NO: 320 - DNA, 28 bp, Artificial sequence
  oligonucleotide for introducing mutation within the ISU of lentiviral ENV protein
cccaggagctgtcgatcctttaggtatc

SEQ ID NO: 321 - DNA, 28 bp, Artificial sequence
  oligonucleotide for introducing mutation within the ISU of lentiviral ENV protein
gatacctaaaggatcgacagctcctggg

SEQ ID NO: 322 - DNA, 29 bp, Artificial sequence
  oligonucleotide for introducing mutation within the ISU of lentiviral ENV protein
caaatccccaggagccgttgatcctttag

SEQ ID NO: 323 - DNA, 29 bp, Artificial sequence
  oligonucleotide for introducing mutation within the ISU of lentiviral ENV protein
ctaaaggatcaacggctcctggggatttg

SEQ ID NO: 324 - DNA, 29 bp, Artificial sequence
  oligonucleotide for introducing mutation within the ISU of lentiviral ENV protein
caaatccccaggcgctgttgatcctttag

SEQ ID NO: 325 - DNA, 29 bp, Artificial sequence
  oligonucleotide for introducing mutation within the ISU of lentiviral ENV protein
ctaaaggatcaacagcgcctggggatttg

SEQ ID NO: 326 - DNA, 22 bp, Artificial sequence
  oligonucleotide for introducing mutation within the ISU of lentiviral ENV protein
cccaaatcccccggagctgttg

SEQ ID NO: 327 - DNA, 22 bp, Artificial sequence
  oligonucleotide for introducing mutation within the ISU of lentiviral ENV protein
caacagctccgggggatttggg

SEQ ID NO: 328 - DNA, 23 bp, Artificial sequence
  oligonucleotide for introducing mutation within the ISU of lentiviral ENV protein
ccccaaatccgcaggagctgttg

SEQ ID NO: 329 - DNA, 23 bp, Artificial sequence
  oligonucleotide for introducing mutation within the ISU of lentiviral ENV protein
caacagctcctgcggatttgggg

SEQ ID NO: 330 - DNA, 24 bp, Artificial sequence
  oligonucleotide for introducing mutation within the ISU of lentiviral ENV protein
gcaaccccatctccccaggagctg

SEQ ID NO: 331 - DNA, 24 bp, Artificial sequence
  oligonucleotide for introducing mutation within the ISU of lentiviral ENV protein
cagctcctggggagatggggttgc

SEQ ID NO: 332 - DNA, 24 bp, Artificial sequence
  oligonucleotide for introducing mutation within the ISU of lentiviral ENV protein
gcaaccccatctccccaggagctg

SEQ ID NO: 333 - DNA, 24 bp, Artificial sequence
  oligonucleotide for introducing mutation within the ISU of lentiviral ENV protein
cagctcctggggagatggggttgc

SEQ ID NO: 334 - DNA, 31 bp, Artificial sequence
  oligonucleotide for introducing mutation within the ISU of lentiviral ENV protein
gttgatcctttagttttctttccacagccag

SEQ ID NO: 335 - DNA, 31 bp, Artificial sequence
  oligonucleotide for introducing mutation within the ISU of lentiviral ENV protein
ctggctgtggaaagaaaactaaaggatcaac

SEQ ID NO: 336 - DNA, 31 bp, Artificial sequence
  oligonucleotide for introducing mutation within the ISU of lentiviral ENV protein
gttgatcctttaggtgtctttccacagccag

SEQ ID NO: 337 - DNA, 31 bp, Artificial sequence
  oligonucleotide for introducing mutation within the ISU of lentiviral ENV protein
ctggctgtggaaagacacctaaaggatcaac

SEQ ID NO: 338 - DNA, 31 bp, Artificial sequence
  oligonucleotide for introducing mutation within the ISU of lentiviral ENV protein
gttgatcctttagggctctttccacagccag

SEQ ID NO: 339 - DNA, 31 bp, Artificial sequence
  oligonucleotide for introducing mutation within the ISU of lentiviral ENV protein
ctggctgtggaaagagccctaaaggatcaac

SEQ ID NO: 340 - DNA, 31 bp, Artificial sequence
  oligonucleotide for introducing mutation within the ISU of lentiviral ENV protein
gttgatcctttaggcctctttccacagccag

SEQ ID NO: 341 - DNA, 31 bp, Artificial sequence
  oligonucleotide for introducing mutation within the ISU of lentiviral ENV protein
ctggctgtggaaagaggcctaaaggatcaac

SEQ ID NO: 342 - DNA, 31 bp, Artificial sequence
  oligonucleotide for introducing mutation within the ISU of lentiviral ENV protein
gttgatcctttaggaatctttccacagccag

SEQ ID NO: 343 - DNA, 31 bp, Artificial sequence
  oligonucleotide for introducing mutation within the ISU of lentiviral ENV protein
ctggctgtggaaagattcctaaaggatcaac

SEQ ID NO: 344 - DNA, 31 bp, Artificial sequence
  oligonucleotide for introducing mutation within the ISU of lentiviral ENV protein
gttgatcctttaggagtctttccacagccag

SEQ ID NO: 345 - DNA, 31 bp, Artificial sequence
  oligonucleotide for introducing mutation within the ISU of lentiviral ENV protein
ctggctgtggaaagactcctaaaggatcaac

SEQ ID NO: 346 - DNA, 31 bp, Artificial sequence
  oligonucleotide for introducing mutation within the ISU of lentiviral ENV protein
acaaattagatgttcatcaaatattacaggg

SEQ ID NO: 347 - DNA, 44 bp, Artificial sequence
  oligonucleotide for introducing mutation within the ISU of lentiviral ENV protein
gcaacagatgctgttgggcctcaatggccctcagcaaattgttc

SEQ ID NO: 348 - DNA, 44 bp, Artificial sequence
  oligonucleotide for introducing mutation within the ISU of lentiviral ENV protein
gaacaatttgctgagggccattgaggcccaacagcatctgttgc

SEQ ID NO: 349 - DNA, 32 bp, Artificial sequence
  oligonucleotide for introducing mutation within the ISU of lentiviral ENV protein
gtgtattaagcttgtgtaattgttaatttctc

SEQ ID NO: 350 - DNA, 25 bp, Artificial sequence
  oligonucleotide for introducing mutation within the ISU of lentiviral ENV protein
ccgctcagtcccgaactttattggc

SEQ ID NO: 351 - DNA, 22 bp, Artificial sequence
  oligonucleotide for introducing mutation within the ISU of lentiviral ENV protein
ggtggggaagagaacactggcc

SEQ ID NO: 352 - DNA, 45 bp, Artificial sequence
  oligonucleotide for introducing mutation within the ISU of lentiviral ENV protein
cagactagggtcactgccatccgcaagtacttaaaggaccaggcg

SEQ ID NO: 353 - DNA, 45 bp, Artificial sequence
  oligonucleotide for introducing mutation within the ISU of lentiviral ENV protein
cgcctggtcctttaagtacttgcggatggcagtgaccctagtctg

SEQ ID NO: 354 - DNA, 45 bp, Artificial sequence
  oligonucleotide for introducing mutation within the ISU of lentiviral ENV protein
actagggtcactgccatcgagcgctacttaaaggaccaggcgcag

SEQ ID NO: 355 - DNA, 45 bp, Artificial sequence
  oligonucleotide for introducing mutation within the ISU of lentiviral ENV protein
ctgcgcctggtcctttaagtagcgctcgatggcagtgaccctagt

SEQ ID NO: 356 - DNA, 30 bp, Artificial sequence
  oligonucleotide for introducing mutation within the ISU of lentiviral ENV protein
gccatcgagaagcgcttaaaggaccaggcg

SEQ ID NO: 357 - DNA, 30 bp, Artificial sequence
  oligonucleotide for introducing mutation within the ISU of lentiviral ENV protein
cgcctggtcctttaagcgcttctcgatggc

SEQ ID NO: 358 - DNA, 42 bp, Artificial sequence
  oligonucleotide for introducing mutation within the ISU of lentiviral ENV protein
gtcactgccatcgagaagtaccgcaaggaccaggcgcagctg

SEQ ID NO: 359 - DNA, 42 bp, Artificial sequence
  oligonucleotide for introducing mutation within the ISU of lentiviral ENV protein
cagctgcgcctggtccttgcggtacttctcgatggcagtgac

SEQ ID NO: 360 - DNA, 45 bp, Artificial sequence
  oligonucleotide for introducing mutation within the ISU of lentiviral ENV protein
gccatcgagaagtacttacgcgaccaggcgcagctgaatgcttgg

SEQ ID NO: 361 - DNA, 45 bp, Artificial sequence
  oligonucleotide for introducing mutation within the ISU of lentiviral ENV protein
ccaagcattcagctgcgcctggtcgcgtaagtacttctcgatggc

SEQ ID NO: 362 - DNA, 39 bp, Artificial sequence
  oligonucleotide for introducing mutation within the ISU of lentiviral ENV protein
gagaagtacttaaagcgccaggcgcagctgaatgcttgg

SEQ ID NO: 363 - DNA, 39 bp, Artificial sequence
  oligonucleotide for introducing mutation within the ISU of lentiviral ENV protein
attcagctgcgcctggcgctttaagtacttctcgatggc

SEQ ID NO: 364 - DNA, 36 bp, Artificial sequence
  oligonucleotide for introducing mutation within the ISU of lentiviral ENV protein
acatggcccagccggccgctgggatagtgcagcaac

SEQ ID NO: 365 - DNA, 35 bp, Artificial sequence
  oligonucleotide for introducing mutation within the ISU of lentiviral ENV protein
gtatacgcgtttaaaacgcacatccccaagcattc

SEQ ID NO: 366 - protein, 49 aa, Artificial sequence
  derived from the ISU domain of HIV1
SGIVQQQNNLLRAIEAQQHLLQLTVWGIKQLQARILAVERYLKDQQLLG

SEQ ID NO: 367 - protein, 49 aa, Artificial sequence
  derived from the ISU domain of HIV1
SGIVQQQNNLLRAIEAQQHLLKLTVWGIKQLQARILAVERYLKDQQLLG

SEQ ID NO: 368 - protein, 49 aa, Artificial sequence
  derived from the ISU domain of HIV1
SGIVQQQNNLLRAIEAQQHLLQLTVWGIKQLQARVLAVERYLKDQQLLG

SEQ ID NO: 369 - protein, 49 aa, Artificial sequence; identical to SEQ ID NO: 366
  derived from the ISU domain of HIV1

SEQ ID NO: 370 - protein, 49 aa, Artificial sequence
  derived from the ISU domain of HIV1
SGIVQQQNNLLRAIEAQQQMLQLTVWGIKQLRARVLAVERYLRDQQLLG

SEQ ID NO: 371 - protein, 49 aa, Artificial Sequence
  derived from the ISU domain of HIV1
SGIVQQQSNLLRAIQARQHMLQLTVWGIKQLQARVLAVERYLRDQQLLG

SEQ ID NO: 372 - protein, 49 aa, Artificial sequence
  derived from the ISU domain of SIV
SGIVQQQNNLLKAIEAQQHLLQLSIWGVKQLQARLLAVERYLQDQQILG

SEQ ID NO: 373 - protein, 49 aa, Artificial sequence
  derived from the ISU domain of SIV
SGIVQQQNNLLRAIEAQQHLLQLSVWGIKQLQARVLAIERYLRDQQILG

SEQ ID NO: 374 - protein, 49 aa, Artificial sequence
  derived from the ISU domain of SIV
AGIVQQQQQLLDVVKRQQELLRLTVWGTKNLQTRVSAIEKYLKDQAQLN

SEQ ID NO: 375 - protein, 49 aa, Artificial Sequence
  derived from the ISU domain of SIV
AGIVQQQQQLLDVVKRQQELLRLTVWGTKNLQTRVTAIEKYLKDQAQLN

SEQ ID NO: 376 - protein, 49 aa, Artificial sequence
  derived from the ISU domain of HIV2
AGIVQQQQQLLDVVKRQQEMLRLTVWGTKNLQARVTAIEKYLKDQAQLN

SEQ ID NO: 377 - protein, 49 aa, Artificial Sequence
  derived from the ISU domain of HIV2
AGIVQQQQQLLDVVKRQQELLRLTVWGTKNLQTRVTAIEKYLKDQALLN

SEQ ID NO: 378 - DNA, 31 bp, Artificial sequence
  Oligonucleotide used for introducing a second mutation
ctggctgtggaagcacgcctaaaggatcaac

SEQ ID NO: 379 - DNA, 31 bp, Artificial sequence
  Oligonucleotide used for introducing a second mutation
gttgatcctttaggcgtgcttccacagccag

SEQ ID NO: 380 - DNA, 31 bp, Artificial sequence
  Oligonucleotide used for introducing a second mutation
ctggctgtggaagaacgcctaaaggatcaac

SEQ ID NO: 381 - DNA, 31 bp, Artificial sequence
  Oligonucleotide used for introducing a second mutation
gttgatcctttaggcgttcttccacagccag

SEQ ID NO: 382 - DNA, 31 bp, Artificial sequence
  Oligonucleotide used for introducing a second mutation
ctggctgtggaagctgccctaaaggatcaac

SEQ ID NO: 383 - DNA, 31 bp, Artificial sequence
  Oligonucleotide used for introducing a second mutation
gttgatcctttagggcagcttccacagccag

SEQ ID NO: 384 - DNA, 31 bp, Artificial sequence
  Oligonucleotide used for introducing a second mutation
ctggctgtggaagaagccctaaaggatcaac

SEQ ID NO: 385 - DNA, 31 bp, Artificial sequence
  Oligonucleotide used for introducing a second mutation
gttgatcctttagggcttcttccacagccag

SEQ ID NO: 386 - DNA, 31 bp, Artificial sequence
  Oligonucleotide used for introducing a second mutation
ctggctgtggaaagcgccctaaaggatcaac

SEQ ID NO: 387 - DNA, 31 bp, Artificial sequence
  Oligonucleotide used for introducing a second mutation
gttgatcctttagggcgctttccacagccag

SEQ ID NO: 388 - DNA, 31 bp, Artificial sequence
  Oligonucleotide used for introducing a second mutation
ctggctgtggaaacagccctaaaggatcaac

SEQ ID NO: 389 - DNA, 31 bp, Artificial sequence
  Oligonucleotide used for introducing a second mutation
gttgatcctttagggctgtttccacagccag

SEQ ID NO: 390 - DNA, 31 bp, Artificial sequence
  Oligonucleotide used for introducing a second mutation
ctggctgtggaagcttacctaaaggatcaac

SEQ ID NO: 391 - DNA, 31 bp, Artificial sequence
  Oligonucleotide used for introducing a second mutation
gttgatcctttaggtaagcttccacagccag

SEQ ID NO: 392 - DNA, 31 bp, Artificial sequence
  Oligonucleotide used for introducing a second mutation
ctggctgtggaagaatacctaaaggatcaac

SEQ ID NO: 393 - DNA, 31 bp, Artificial sequence
  Oligonucleotide used for introducing a second mutation
gttgatcctttaggtattcttccacagccag

SEQ ID NO: 394 - DNA, 31 bp, Artificial sequence
  Oligonucleotide used for introducing a second mutation
ctggctgtggaaagctacctaaaggatcaac

SEQ ID NO: 395 - DNA, 31 bp, Artificial sequence
  Oligonucleotide used for introducing a second mutation
gttgatcctttaggtagctttccacagccag

SEQ ID NO: 396 - DNA, 31 bp, Artificial sequence
  Oligonucleotide used for introducing a second mutation
ctggctgtggaaacatacctaaaggatcaac

SEQ ID NO: 397 - DNA, 31 bp, Artificial sequence
  Oligonucleotide used for introducing a second mutation
gttgatcctttaggtatgtttccacagccag

SEQ ID NO: 398 - DNA, 36 bp, Artificial sequence
  Oligonucleotide used for introducing a second mutation
gctagttggagtaatgcatctctggaacagatttgg

SEQ ID NO: 399 - DNA, 36 bp, Artificial sequence
  Oligonucleotide used for introducing a second mutation
ccaaatctgttccagagatgcattactccaactagc

SEQ ID NO: 400 - DNA, 36 bp, Artificial sequence
  Oligonucleotide used for introducing a second mutation
gctagttggagtaatggatctctggaacagatttgg

SEQ ID NO: 401 - DNA, 36 bp, Artificial sequence
  Oligonucleotide used for introducing a second mutation
ccaaatctgttccagagatccattactccaactagc

SEQ ID NO: 402 - DNA, 36 bp, Artificial sequence
  Oligonucleotide used for introducing a second mutation
gctagttggagtaattcatctctggaacagatttgg

SEQ ID NO: 403 - DNA, 36 bp, Artificial Sequence
  Oligonucleotide used for introducing a second mutation
ccaaatctgttccagagatgaattactccaactagc

SEQ ID NO: 404 - DNA, 54 bp, Artificial Sequence
  oligonucleotide for introducing mutation within the ISU of lentiviral ENV protein
  misc_feature (1)..(5): n is a, c, g, or t
nnnnnctcgagaccggtccaactagaaccatgagagtgaaggagaaatatcagc

SEQ ID NO: 405 - DNA, 31 bp, Artificial Sequence
  oligonucleotide for introducing mutation within the ISU of lentiviral ENV protein
  misc_feature (1)..(5): n is a, c, g, or t
nnnnnacgcgttcaatatccctgcctaactc

SEQ ID NO: 406 - DNA, 34 bp, Artificial Sequence
  oligonucleotide for introducing mutation within the ISU of lentiviral ENV protein
  misc_feature (1)..(5): n is a, c, g, or t
nnnnnacgcgtttatagcaaaatcctttccaagc

SEQ ID NO: 407 - protein, 8 aa, Artificial sequence
  fragment of lentiviral ENV ISU
AVEAALKD

SEQ ID NO: 408 - protein, 8 aa, Artificial sequence
  fragment of lentiviral ENV ISU
AVEEALKD

SEQ ID NO: 409 - protein, 8 aa, Artificial sequence
  fragment of lentiviral ENV ISU
AVESALKD

SEQ ID NO: 410 - protein, 8 aa, Artificial sequence
  fragment of lentiviral ENV ISU
AVETALKD

SEQ ID NO: 411 - protein, 8 aa, Artificial sequence
  fragment of lentiviral ENV ISU
AIEAALKD

SEQ ID NO: 412 - protein, 8 aa, Artificial sequence
  fragment of lentiviral ENV ISU
AIEEALKD

SEQ ID NO: 413 - protein, 8 aa, Artificial sequence
  fragment of lentiviral ENV ISU
AIESALKD

SEQ ID NO: 414 - protein, 8 aa, Artificial sequence
  fragment of lentiviral ENV ISU
AIETALKD

SEQ ID NO: 415 - protein, 38 aa, Artificial Sequence
  derived from lentiviral ENV protein
  MISC_FEATURE (2)..(2): Xaa = I or V
  MISC_FEATURE (4)..(4): Xaa = K or R
  misc_feature (7)..(7): Xaa can be any naturally occurring amino acid
  misc_feature (10)..(11): Xaa can be any naturally occurring amino acid
  misc_feature (13)..(14): Xaa can be any naturally occurring amino acid
  MISC_FEATURE (18)..(18): Xaa = A or S
  MISC_FEATURE (19)..(19): Xaa = F or G
  misc_feature (20)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  MISC_FEATURE (31)..(35): Xaa = no or any amino acid
  MISC_FEATURE (36)..(36): Xaa = N or S
  MISC_FEATURE (37)..(37): Xaa = E, D, N or A
  MISC_FEATURE (38)..(38): Xaa = S or T
AXEXYLXDQXXLXXWGCXXXXCVXTXVPWXXXXXXXXX

SEQ ID NO: 416 - protein, 9 aa, Artificial sequence
  fragment of lentiviral ENV ISU
  MISC_FEATURE (2)..(2): Xaa = I or V
  MISC_FEATURE (4)..(4): Xaa = K or R
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
AXEXXXXDQ

SEQ ID NO: 417 - protein, 861 aa, Human immunodeficiency virus type 1
MRVKEKYQHLWRWGWKWGTMLLGILMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLGNATNTNSSNTNSSSGEMMMEKGEIKNCSFNISTSIRGKVQKEYAFFYKLDIIPIDNDTTSYTLTSCNTSVITQACPKVSFEPIPIHYCAPAGFAILKCNNKTFNGTGPCTNVSTVQCTHGIRPVVSTQLLLNGSLAEEEVVIRSANFTDNAKTIIVQLNQSVEINCTRPNNNTRKSIRIQRGPGRAFVTIGKIGNMRQAHCNISRAKWNATLKQIASKLREQFGNNKTIIFKQSSGGDPEIVTHSFNCGGEFFYCNSTQLFNSTWFNSTWSTEGSNNTEGSDTITLPCRIKQFINMWQEVGKAMYAPPISGQIRCSSNITGLLLTRDGGNNNNGSEIFRPGGGDMRDNWRSELYKYKVVKIEPLGVAPTKAKRRVVQREKRAVGIGALFLGFLGAAGSTMGARSMTLTVQARQLLSGIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQELLELDKWASLWNWFNITNWLWYIKIFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 418 - protein, 859 aa, Human immunodeficiency virus type 2
MCGRNQLFVASLLASACLIYCVQYVTVFYGVPVWRNASIPLFCATKNRDTWGTIQCLPDNDDYQEIALNVTEAFDAWNNTVTEQAVEDVWSLFETSIKPCVKLTPLCVAMRCNSTTAKNTTSTPTTTTTANTTIGENSSCIRTDNCTGLGEEEMVDCQFNMTGLERDKKKLYNETWYSKDVVCESNDTKKEKTCYMNHCNTSVITESCDKHYWDTMRFRYCAPPGFALLRCNDTNYSGFEPNCSKVVAATCTRMMETQTSTWFGFNGTRAENRTYIYWHGRDNRTIISLNKFYNLTVHCKRPGNKTVVPITLMSGLVFHSQPINRRPRQAWCWFKGEWKEAMKEVKLTLAKHPRYKGTNDTEKIRFIAPGERSDPEVAYMWTNCRGEFLYCNMTWFLNWVENRTNQTQHNYVPCHIKQIINTWHKVGKNVYLPPREGQLTCNSTVTSIIANIDGGENQTNITFSAEVAELYRLELGDYKLIEVTPIGFAPTPVKRYSSAPVRNKRGVFVLGFLGFLTTAGAAMGAASLTLSAQSRTLLAGIVQQQQQLLDVVKRQQEMLRLTVWGTKNLQARVTAIEKYLKDQAQLNSWGCAFRQVCHTTVPWVNDTLTPDWNNMTWQEWEQRIRNLEANISESLEQAQIQQEKNMYELQKLNSWDVFGNWFDLTSWIKYIQYGVYIVVGIIVLRIVIYVVQMLSRLRKGYRPVFSSPPAYFQQIHIHKDREQPAREETEEDVGNSVGDNWWPWPIRYIHFLIRQLIRLLNRLYNICRDLLSRSFQTLQLISQSLRRALTAVRDWLRFNTAYLQYGGEWIQEAFRAFARATGETLTNAWRGFWGTLGQIGRGILAVPRRIRQGAEIALL

SEQ ID NO: 419 - protein, 879 aa, Simian immunodeficiency virus
MGCLGNQLLIAILLLSVYGIYCTLYVTVFYGVPAWRNATIPLFCATKNRDTWGTTQCLPDNGDYSEVALNVTESFDAWNNTVTEQAIEDVWQLFETSIKPCVKLSPLCITMRCNKSETDRWGLTKSITTTASTTSTTASAKVDMVNETSSCIAQDNCTGLEQEQMISCKFNMTGLKRDKKKEYNETWYSADLVCEQGNNTGNESRCYMNHCNTSVIQESCDKHYWDAIRFRYCAPPGYALLRCNDTNYSGFMPKCSKVVVSSCTRMMETQTSTWFGFNGTRAENRTYIYWHGRDNRTIISLNKYYNLTMKCRRPGNKTVLPVTIMSGLVFHSQPINDRPKQAWCWFGGKWKDAIKEVKQTIVKHPRYTGTNNTDKINLTAPGGGDPEVTFMWTNCRGEFLYCKMNWFLNWVEDRNTANQKPKEQHKRNYVPCHIRQIINTWHKVGKNVYLPPREGDLTCNSTVTSLIANIDWIDGNQTNITMSAEVAELYRLELGDYKLVEITPIGLAPTDVKRYTTGGTSRNKRGVFVLGFLGFLATAGSAMGAASLTLTAQSRTLLAGIVQQQQQLLDVVKRQQELLRLTVWGTKNLQTRVTAIEKYLKDQAQLNAWGCAFRQVCHTTVPWPNASLTPKWNNETWQEWERKVDFLEENITALLEEAQIQQEKNMYELQKLNSWDVFGNWFDLASWIKYIQYGVYIVVGVILLRIVIYIVQMLAKLRQGYRPVFSSPPSYFQQTHIQQDPALPTREGKERDGGEGGGNSSWPWQIEYIHFLIRQLIRLLTWLFSNCRTLLSRVYQILQPILQRLSATLQRIREVLRTELTYLQYGWSYFHEAVQAVWRSATETLAGAWGDLWETLRRGGRWILAIPRRIRQGLELTLL

SEQ ID NO: 420 - protein, 859 aa, Human immunodeficiency virus type 2
MCGRNQLFVASLLASACLIYCVQYVTVFYGVPVWRNASIPLFCATKNRDTWGTIQCLPDNDDYQEIALNVTEAFDAWNNTVTEQAVEDVWSLFETSIKPCVKLTPLCVAMRCNSTTAKNTTSTPTTTTTANTTIGENSSCIRTDNCTGLGEEEMVDCQFNMTGLERDKKKLYNETWYSKDVVCESNDTKKEKTCYMNHCNTSVITESCDKHYWDTMRFRYCAPPGFALLRCNDTNYSGFEPNCSKVVAATCTRMMETQTSTWFGFNGTRAENRTYIYWHGRDNRTIISLNKFYNLTVHCKRPGNKTVVPITLMSGLVFHSQPINRRPRQAWCWFKGEWKEAMKEVKLTLAKHPRYKGTNDTEKIRFIAPGERSDPEVAYMWTNCRGEFLYCNMTWFLNWVENRTNQTQHNYVPCHIKQIINTWHKVGKNVYLPPREGQLTCNSTVTSIIANIDGGENQTNITFSAEVAELYRLELGDYKLIEVTPIGFAPTPVKRYSSAPVRNKRGVFVLGFLGFLTTAGAAMGAASLTLSAQSRTLLAGIVQQQQQLLDVVKRQQEMLRLTVWGTKNLQARVTAIEKRLKDQAQLNSWGCAFRQVCHTTVPWVNDTLTPDWNNMTWQEWEQRIRNLEANISESLEQAQIQQEKNMYELQKLNSWDVFGNWFDLTSWIKYIQYGVYIVVGIIVLRIVIYVVQMLSRLRKGYRPVFSSPPAYFQQIHIHKDREQPAREETEEDVGNSVGDNWWPWPIRYIHFLIRQLIRLLNRLYNICRDLLSRSFQTLQLISQSLRRALTAVRDWLRFNTAYLQYGGEWIQEAFRAFARATGETLTNAWRGFWGTLGQIGRGILAVPRRIRQGAEIALL

SEQ ID NO: 421 - protein, 879 aa, Simian immunodeficiency virus
MGCLGNQLLIAILLLSVYGIYCTLYVTVFYGVPAWRNATIPLFCATKNRDTWGTTQCLPDNGDYSEVALNVTESFDAWNNTVTEQAIEDVWQLFETSIKPCVKLSPLCITMRCNKSETDRWGLTKSITTTASTTSTTASAKVDMVNETSSCIAQDNCTGLEQEQMISCKFNMTGLKRDKKKEYNETWYSADLVCEQGNNTGNESRCYMNHCNTSVIQESCDKHYWDAIRFRYCAPPGYALLRCNDTNYSGFMPKCSKVVVSSCTRMMETQTSTWFGFNGTRAENRTYIYWHGRDNRTIISLNKYYNLTMKCRRPGNKTVLPVTIMSGLVFHSQPINDRPKQAWCWFGGKWKDAIKEVKQTIVKHPRYTGTNNTDKINLTAPGGGDPEVTFMWTNCRGEFLYCKMNWFLNWVEDRNTANQKPKEQHKRNYVPCHIRQIINTWHKVGKNVYLPPREGDLTCNSTVTSLIANIDWIDGNQTNITMSAEVAELYRLELGDYKLVEITPIGLAPTDVKRYTTGGTSRNKRGVFVLGFLGFLATAGSAMGAASLTLTAQSRTLLAGIVQQQQQLLDVVKRQQELLRLTVWGTKNLQTRVTAIEKRLKDQAQLNAWGCAFRQVCHTTVPWPNASLTPKWNNETWQEWERKVDFLEENITALLEEAQIQQEKNMYELQKLNSWDVFGNWFDLASWIKYIQYGVYIVVGVILLRIVIYIVQMLAKLRQGYRPVFSSPPSYFQQTHIQQDPALPTREGKERDGGEGGGNSSWPWQIEYIHFLIRQLIRLLTWLFSNCRTLLSRVYQILQPILQRLSATLQRIREVLRTELTYLQYGWSYFHEAVQAVWRSATETLAGAWGDLWETLRRGGRWILAIPRRIRQGLELTLL

SEQ ID NO: 422 - protein, 9 aa, Artificial sequence
  fragment of lentiviral ENV ISU
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
AIEKXXXDQ

SEQ ID NO: 423 - protein, 9 aa, Artificial sequence
  fragment of lentiviral ENV ISU
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
AIERXXXDQ

SEQ ID NO: 424 - protein, 9 aa, Artificial sequence
  fragment of lentiviral ENV ISU
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
AVEKXXXDQ

SEQ ID NO: 425 - protein, 9 aa, Artificial sequence
  fragment of lentiviral ENV ISU
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
AVERXXXDQ

SEQ ID NO: 426 - protein, 38 aa, Artificial sequence
  fragment of lentiviral ENV ISU
  MISC_FEATURE (2)..(2): Xaa = I or V
  MISC_FEATURE (4)..(4): Xaa = K or R
  MISC_FEATURE (5)..(5): Xaa is any naturally occuring amino acid or is mutated
  MISC_FEATURE (6)..(6): Xaa is any naturally occuring amino acid or is mutated
  MISC_FEATURE (7)..(7): Xaa can be any naturally occuring amino acid
  MISC_FEATURE (10)..(10): Xaa can be any naturally occuring amino acid
  MISC_FEATURE (11)..(11): Xaa can be any naturally occuring amino acid
  MISC_FEATURE (13)..(13): Xaa can be any naturally occuring amino acid
  MISC_FEATURE (14)..(14): Xaa can be any naturally occuring amino acid
  MISC_FEATURE (18)..(18): Xaa = A or S
  MISC_FEATURE (19)..(19): Xaa = F or G
  MISC_FEATURE (20)..(20): Xaa can be any naturally occuring amino acid
  MISC_FEATURE (21)..(21): Xaa can be any naturally occuring amino acid
  MISC_FEATURE (24)..(24): Xaa can be any naturally occuring amino acid
  MISC_FEATURE (26)..(26): Xaa can be any naturally occuring amino acid
  MISC_FEATURE (29)..(29): Xaa is any naturally occuring amino acid or is mutated
  MISC_FEATURE (30)..(30): Xaa can be naturally occuring amino acid
  MISC_FEATURE (31)..(35): Xaa can be any naturally occuring amino acid
  MISC_FEATURE (36)..(36): Xaa is any naturally occuring amino acid or is mutated
  MISC_FEATURE (37)..(37): Xaa is any naturally occuring amino acid or is mutated
  MISC_FEATURE (38)..(38): Xaa = S or T
AXEXXXXDQXXLXXWGCXXXXCVXTXVPXXXXXXXXXX

SEQ ID NO: 427 - protein, 9 aa, Artificial sequence
  fragment of lentiviral ENV ISU
  MISC_FEATURE (2)..(2): Xaa = I or V
  MISC_FEATURE (4)..(4): Xaa = K or R
  MISC_FEATURE (5)..(5): Xaa is any naturally occuring amino acid
  MISC_FEATURE (6)..(6): Xaa is any naturally occuring amino acid
  MISC_FEATURE (7)..(7): Xaa can be any naturally occuring amino acid
AXEXXXXDQ

SEQ ID NO: 428 - protein, 15 aa, Artificial sequence
  fragment of lentiviral ENV ISU
  MISC_FEATURE (1)..(1): Xaa is any naturally occuring amino acid or is mutated
  MISC_FEATURE (2)..(2): Xaa is any naturally occuring amino acid or is mutated
  MISC_FEATURE (3)..(3): Xaa is any naturally occuring amino acid or is mutated
  MISC_FEATURE (4)..(4): Xaa is any naturally occuring amino acid or is mutated
  MISC_FEATURE (8)..(8): Xaa = I or V
  MISC_FEATURE (10)..(10): Xaa = K or R
  MISC_FEATURE (11)..(11): Xaa is any naturally occuring amino acid or is mutated
  MISC_FEATURE (12)..(12): Xaa is any naturally occuring amino acid or is mutated
  MISC_FEATURE (13)..(13): Xaa = any naturally occuring amino acid
XXXXILAXEXXXXDQ

SEQ ID NO: 429 - protein, 21 aa, Endogenous or onco retrovirus
LQNRRGLDLLFLKEGGLCAAL

SEQ ID NO: 430 - protein, 21 aa, Lentivirus
LAVERYLKDQQLLGIWGCSGK

SEQ ID NO: 431 - protein, 30 aa, Human immunodeficiency virus type 1
SGIVQQQNNLLRAIEAQQHLLQLTVWGIKQ

SEQ ID NO: 432 - protein, 37 aa, Human immunodeficiency virus type 1
SGIVQQQNNLLRAIEAQQHLLQLTVWGIKQLQARILA

SEQ ID NO: 433 - protein, 43 aa, Human immunodeficiency virus type 1
SGIVQQQNNLLRAIEAQQHLLQLTVWGIKQLQARILAVERYLK

SEQ ID NO: 434 - protein, 49 aa, Human immunodeficiency virus type 1; identical to SEQ ID NO: 366

SEQ ID NO: 435 - protein, 55 aa, Human immunodeficiency virus type 1
SGIVQQQNNLLRAIEAQQHLLQLTVWGIKQLQARILAVERYLKDQQLLGIWGCSG

SEQ ID NO: 436 - protein, 67 aa, Human immunodeficiency virus type 1
SGIVQQQNNLLRAIEAQQHLLQLTVWGIKQLQARILAVERYLKDQQLLGIWGCSGKLICTTAVPWNA

SEQ ID NO: 437 - protein, 81 aa, Human immunodeficiency virus type 1
SGIVQQQNNLLRAIEAQQHLLQLTVWGIKQLQARILAVERYLKDQQLLGIWGCSGKLICTTAVPWNASWSNKSLEQIWNNM

SEQ ID NO: 438 - protein, 115 aa, Human immunodeficiency virus type 1
SGIVQQQNNLLRAIEAQQHLLQLTVWGIKQLQARILAVERYLKDQQLLGIWGCSGKLICTTAVPWNASWSNKSLEQIWNNMTWMEWDREINNYTSLIHSLIEESQNQQEKNEQEL

SEQ ID NO: 439 - protein, 115 aa, Human immunodeficiency virus type 1
SGIVQQQNNLLRAIEAQQHLLQLTVWGIKQLQARIRAVERYLKDQQLLGIWGCSGKLICTTAVPWNASWSNKSLEQIWNNMTWMEWDREINNYTSLIHSLIEESQNQQEKNEQEL

SEQ ID NO: 440 - protein, 115 aa, Human immunodeficiency virus type 1
SGIVQQQNNLLRAIEAQQHLLQLTVWGIKQLQARILRVERYLKDQQLLGIWGCSGKLICTTAVPWNASWSNKSLEQIWNNMTWMEWDREINNYTSLIHSLIEESQNQQEKNEQEL

SEQ ID NO: 441 - protein, 115 aa, Human immunodeficiency virus type 1
SGIVQQQNNLLRAIEAQQHLLQLTVWGIKQLQARILARERYLKDQQLLGIWGCSGKLICTTAVPWNASWSNKSLEQIWNNMTWMEWDREINNYTSLIHSLIEESQNQQEKNEQEL

SEQ ID NO: 442 - protein, 115 aa, Human immunodeficiency virus type 1
SGIVQQQNNLLRAIEAQQHLLQLTVWGIKQLQARILAVRRYLKDQQLLGIWGCSGKLICTTAVPWNASWSNKSLEQIWNNMTWMEWDREINNYTSLIHSLIEESQNQQEKNEQEL

SEQ ID NO: 443 - protein, 115 aa, Human immunodeficiency virus type 1
SGIVQQQNNLLRAIEAQQHLLQLTVWGIKQLQARILAVERRLKDQQLLGIWGCSGKLICTTAVPWNASWSNKSLEQIWNNMTWMEWDREINNYTSLIHSLIEESQNQQEKNEQEL

SEQ ID NO: 444 - protein, 115 aa, Human immunodeficiency virus type 1
SGIVQQQNNLLRAIEAQQHLLQLTVWGIKQLQARILAVERYRKDQQLLGIWGCSGKLICTTAVPWNASWSNKSLEQIWNNMTWMEWDREINNYTSLIHSLIEESQNQQEKNEQEL

SEQ ID NO: 445 - protein, 115 aa, Human immunodeficiency virus type 1
SGIVQQQNNLLRAIEAQQHLLQLTVWGIKQLQARILAVERYLRDQQLLGIWGCSGKLICTTAVPWNASWSNKSLEQIWNNMTWMEWDREINNYTSLIHSLIEESQNQQEKNEQEL

SEQ ID NO: 446 - protein, 115 aa, Human immunodeficiency virus type 1
SGIVQQQNNLLRAIEAQQHLLQLTVWGIKQLQARILAVERYLKRQQLLGIWGCSGKLICTTAVPWNASWSNKSLEQIWNNMTWMEWDREINNYTSLIHSLIEESQNQQEKNEQEL

SEQ ID NO: 447 - protein, 115 aa, Human immunodeficiency virus type 1
SGIVQQQNNLLRAIEAQQHLLQLTVWGIKQLQARILAVERYLKDRQLLGIWGCSGKLICTTAVPWNASWSNKSLEQIWNNMTWMEWDREINNYTSLIHSLIEESQNQQEKNEQEL

SEQ ID NO: 448 - protein, 115 aa, Human immunodeficiency virus type 1
SGIVQQQNNLLRAIEAQQHLLQLTVWGIKQLQARILAVERYLKDQRLLGIWGCSGKLICTTAVPWNASWSNKSLEQIWNNMTWMEWDREINNYTSLIHSLIEESQNQQEKNEQEL

SEQ ID NO: 449 - protein, 115 aa, Human immunodeficiency virus type 1
SGIVQQQNNLLRAIEAQQHLLQLTVWGIKQLQARILAVERYLKDQQRLGIWGCSGKLICTTAVPWNASWSNKSLEQIWNNMTWMEWDREINNYTSLIHSLIEESQNQQEKNEQEL

SEQ ID NO: 450 - protein, 115 aa, Human immunodeficiency virus type 1
SGIVQQQNNLLRAIEAQQHLLQLTVWGIKQLQARILAVERYLKDQQLRGIWGCSGKLICTTAVPWNASWSNKSLEQIWNNMTWMEWDREINNYTSLIHSLIEESQNQQEKNEQEL

SEQ ID NO: 451 - protein, 115 aa, Human immunodeficiency virus type 1
SGIVQQQNNLLRAIEAQQHLLQLTVWGIKQLQARILAVERYLKDQQLLRIWGCSGKLICTTAVPWNASWSNKSLEQIWNNMTWMEWDREINNYTSLIHSLIEESQNQQEKNEQEL

SEQ ID NO: 452 - protein, 115 aa, Human immunodeficiency virus type 1
SGIVQQQNNLLRAIEAQQHLLQLTVWGIKQLQARILAVERYLKDQQLLGRWGCSGKLICTTAVPWNASWSNKSLEQIWNNMTWMEWDREINNYTSLIHSLIEESQNQQEKNEQEL

SEQ ID NO: 453 - protein, 115 aa, Human immunodeficiency virus type 1
SGIVQQQNNLLRAIEAQQHLLQLTVWGIKQLQARILAVERYLKDQQLLGIRGCSGKLICTTAVPWNASWSNKSLEQIWNNMTWMEWDREINNYTSLIHSLIEESQNQQEKNEQEL

SEQ ID NO: 454 - protein, 115 aa, Human immunodeficiency virus type 1
SGIVQQQNNLLRAIEAQQHLLQLTVWGIKQLQARILAVERHLKDQQLLGIWGCSGKLICTTAVPWNASWSNKSLEQIWNNMTWMEWDREINNYTSLIHSLIEESQNQQEKNEQEL

SEQ ID NO: 455 - protein, 115 aa, Human immunodeficiency virus type 1
SGIVQQQNNLLRAIEAQQHLLQLTVWGIKQLQARILAVERKLKDQQLLGIWGCSGKLICTTAVPWNASWSNKSLEQIWNNMTWMEWDREINNYTSLIHSLIEESQNQQEKNEQEL

SEQ ID NO: 456 - protein, 115 aa, Human immunodeficiency virus type 1
SGIVQQQNNLLRAIEAQQHLLQLTVWGIKQLQARILAVERGLKDQQLLGIWGCSGKLICTTAVPWNASWSNKSLEQIWNNMTWMEWDREINNYTSLIHSLIEESQNQQEKNEQEL

SEQ ID NO: 457 - protein, 115 aa, Human immunodeficiency virus type 1
SGIVQQQNNLLRAIEAQQHLLQLTVWGIKQLQARILAVERLLKDQQLLGIWGCSGKLICTTAVPWNASWSNKSLEQIWNNMTWMEWDREINNYTSLIHSLIEESQNQQEKNEQEL

SEQ ID NO: 458 - protein, 115 aa, Human immunodeficiency virus type 1
SGIVQQQNNLLRAIEAQQHLLQLTVWGIKQLQARILAVERALKDQQLLGIWGCSGKLICTTAVPWNASWSNKSLEQIWNNMTWMEWDREINNYTSLIHSLIEESQNQQEKNEQEL

SEQ ID NO: 459 - protein, 115 aa, Human immunodeficiency virus type 1
SGIVQQQNNLLRAIEAQQHLLQLTVWGIKQLQARILAVERFLKDQQLLGIWGCSGKLICTTAVPWNASWSNKSLEQIWNNMTWMEWDREINNYTSLIHSLIEESQNQQEKNEQEL

SEQ ID NO: 460 - protein, 115 aa, Human immunodeficiency virus type 1; identical to SEQ ID NO: 271

SEQ ID NO: 461 - protein, 115 aa, Human immunodeficiency virus type 1; identical to SEQ ID NO: 272

SEQ ID NO: 462 - protein, 115 aa, Human immunodeficiency virus type 1; identical to SEQ ID NO: 273

The invention claimed is:

1. A pharmaceutical composition comprising as active substance:

a) an isolated mutated human or simian lentiviral ENV protein having no or a reduced immunosuppressive activity as compared to a corresponding wild type non-mutated human or simian lentiviral ENV protein, said mutated human or simian lentiviral ENV protein resulting from mutation of the transmembrane (TM) subunit of the corresponding wild type non-mutated human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L or R, and $X_b$ is any amino acid, $X_a$ is any amino acid, and $X_b$ is R, or $X_a$ is A, F, G, L, R, and $X_b$ is R, or b) at least one fragment of said isolated mutated human or simian lentiviral ENV protein having no or a reduced immunosuppressive activity as compared to the corresponding wild type non-mutated human or simian lentiviral ENV protein, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L or R, and $X_b$ is any amino acid, $X_a$ is any amino acid, and $X_b$ is R, or $X_a$ is A, F, G, L, R, and $X_b$ is R, in association with a pharmaceutically acceptable carrier, said absence or reduction of immunosuppressive activity of the above mentioned mutated human or simian lentiviral ENV protein or of the above defined fragment being liable to be assessed by the fact that in an in vivo assay involving engrafted tumor cells rejection, said tumor cells being transduced either so as to express said mutated ENV protein or said fragment (mutated ENV tumor cells), or said tumor cells being transduced so as to express the corresponding wild type non-mutated ENV protein or a fragment thereof (wild type ENV tumor cells), or said tumor cells being not transduced (normal tumor cells), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells−maximum area reached by normal tumor cells)/(maximum area reached by normal tumor cells), and $i_{wild\ type\ env}$ being defined by: (maximum area reached by wild type ENV tumor cells−maximum area reached by normal tumor cells)/(maximum area reached by normal tumor cells).

2. The pharmaceutical composition according to claim 1 comprising as active substance:

a) an isolated mutated human or simian lentiviral ENV protein having no or a reduced immunosuppressive activity as compared to the corresponding wild type non-mutated human or simian lentiviral ENV protein, said mutated human or simian lentiviral ENV protein resulting from mutation of the transmembrane (TM) subunit of the corresponding wild type non-mutated human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L or R, and $X_b$ is L, I, V, M or P, $X_a$ is Y, I, H, C or T, and $X_b$ is R, or $X_a$ is A, F, G, L or R, and $X_b$ is R, or b) at least one fragment of said isolated mutated human or simian lentiviral ENV protein having no or a reduced immunosuppressive activity as compared to the corresponding wild type non-mutated human or simian lentiviral ENV protein, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, F, G, L or R, and $X_b$ is L, I, V, M or P, $X_a$ is Y, I, H, C or T, and $X_b$ is R, or $X_a$ is A, F, G, L or R, and $X_b$ is R, in association with a pharmaceutically acceptable carrier.

3. The pharmaceutical composition according to claim 1 comprising as active substance:

a) an isolated mutated human or simian lentiviral ENV protein having no or a reduced immunosuppressive activity as compared to the corresponding wild type non-mutated human or simian lentiviral ENV protein, said mutated human or simian lentiviral ENV protein resulting from mutation of the transmembrane (TM) subunit of the corresponding wild type non-mutated human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, $X_a$ is Y, and $X_b$ is R, or $X_a$ is A, F, G, L, or R, and $X_b$ is R, or b) at least one fragment of said isolated mutated human or simian lentiviral ENV protein having no or a reduced immunosuppressive activity as compared to the corresponding wild type non-mutated human or simian lentiviral ENV protein, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, $X_a$ is Y, and $X_b$ is R, or $X_a$ is A, F, G, L, or R, and $X_b$ is R, in association with a pharmaceutically acceptable carrier.

4. The pharmaceutical composition according to claim 1 comprising as active substance:

a) an isolated mutated human or simian lentiviral ENV protein having no or a reduced immunosuppressive activity as compared to the corresponding wild type non-mutated human or simian lentiviral ENV protein, said mutated human or simian lentiviral ENV protein resulting from mutation of the transmembrane (TM) subunit of the corresponding wild type non-mutated human or simian lentiviral ENV protein, said mutated human or simian lentiviral ENV protein comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, or $X_a$ is Y, and $X_b$ is R, or b) at least one fragment of said isolated mutated human or simian lentiviral ENV protein having no or a reduced immunosuppressive activity as compared to the corresponding wild type non-mutated human or simian lentiviral ENV protein, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, or $X_a$ is Y, and $X_b$ is R, in association with a pharmaceutically acceptable carrier.

5. The pharmaceutical composition according to claim 1 comprising as active substance:

a) an isolated mutated human or simian lentiviral ENV protein having no or a reduced immunosuppressive activity as compared to the corresponding wild type non-mutated human or simian lentiviral ENV protein, said mutated human or simian lentiviral ENV protein resulting from mutation of the transmembrane (TM) subunit of the corresponding wild type non-mutated human or simian lentiviral ENV protein, said mutated human or simian lentiviral ENV protein comprising a mutated immunosuppressive domain (ISU) containing the following amino acid sequence: A-[I/V]-E-[K/R]-$X_a$-$X_b$-X-D-Q (SEQ ID NO: 416), wherein, X represents any amino acid, and either $X_a$ is A, G or R, and $X_b$ is L, or $X_a$ is Y, and $X_b$ is R, or b) at least one fragment of said isolated mutated human or simian lentiviral ENV protein having no or a reduced immunosuppressive activity as compared to the corresponding wild type non-mutated human or simian lentiviral ENV protein, said fragment comprising at least 40 amino acids, said fragment comprising a mutated immunosuppressive domain (ISU) containing the following amino acid sequence:

A-[I/V]-E-[K/R]-$X_a$-$X_b$-X-D-Q, (SEQ ID NO: 416)

wherein,

X represents any amino acid, and either $X_a$ is A, G or R, and $X_b$ is L, or $X_a$ is Y, and $X_b$ is R, in association with a pharmaceutically acceptable carrier.

6. The pharmaceutical composition according to claim 1, wherein $X_a$ is R, and $X_b$ is L, or $X_a$ is Y, and $X_b$ is R.

7. The pharmaceutical composition according to claim 1, wherein said isolated mutated human or simian lentiviral ENV protein or said fragment of said isolated mutated human or simian lentiviral ENV protein comprises one of the following amino acid sequences A-I-E-K-$X_a$-$X_b$-X-DQ (SEQ ID NO: 422), A-I-E-R-$X_a$-$X_b$-X-DQ (SEQ ID NO: 423), A-V-E-K-$X_a$-$X_b$-X-DQ (SEQ ID NO: 424), A-V-E-R-$X_a$-$X_b$-X-DQ (SEQ ID NO: 425).

8. The pharmaceutical composition according to claim 1, wherein said isolated mutated human or simian lentiviral ENV protein or said fragment of said isolated mutated human or simian lentiviral ENV protein comprises one of the amino acid sequences:

SEQ ID NO: 9, SEQ ID NO: 10, SEQ ID NO: 11, SEQ ID NO: 12, SEQ ID NO: 13, SEQ ID NO: 17, SEQ ID NO: 25, SEQ ID NO: 29, SEQ ID NO: 33, SEQ ID NO: 37, SEQ ID NO: 38, SEQ ID NO: 39, SEQ ID NO: 40, SEQ ID NO: 41, SEQ ID NO: 42, SEQ ID NO: 46, SEQ ID NO: 50, SEQ ID NO: 54, SEQ ID NO: 58, SEQ ID NO: 62, SEQ ID NO: 66, SEQ ID NO: 67, SEQ ID NO: 68, SEQ ID NO: 69, SEQ ID NO: 70, SEQ ID NO: 71, SEQ ID NO: 75, SEQ ID NO: 79, SEQ ID NO: 83, SEQ ID NO: 87, SEQ ID NO: 91, and SEQ ID NO:95.

9. The pharmaceutical composition according to claim 1, wherein said isolated mutated human or simian lentiviral ENV protein or said fragment of said isolated mutated human or simian lentiviral ENV protein comprises one of the amino acid sequences:

SEQ ID NO: 9, SEQ ID NO: 10, SEQ ID NO: 11, SEQ ID NO: 12, SEQ ID NO: 13, SEQ ID NO: 17, SEQ ID NO: 38, SEQ ID NO: 39, SEQ ID NO: 40, SEQ ID NO: 41, SEQ ID NO: 42, SEQ ID NO: 46, SEQ ID NO: 67, SEQ ID NO: 68, SEQ ID NO: 69, SEQ ID NO: 70, SEQ ID NO: 71 and SEQ ID NO: 75.

10. The pharmaceutical composition according to claim 1, wherein said isolated mutated human or simian lentiviral ENV protein or said fragment of said isolated mutated human or simian lentiviral ENV protein comprises one of the amino acid sequences:

SEQ ID NO: 96, SEQ ID NO: 97, SEQ ID NO: 98, SEQ ID NO: 99, SEQ ID NO: 100, SEQ ID NO: 104, SEQ ID NO: 108, SEQ ID NO: 112, SEQ ID NO: 116, SEQ ID NO: 120, SEQ ID NO: 124, SEQ ID NO: 125, SEQ ID NO: 126, SEQ ID NO: 127, SEQ ID NO: 128, SEQ ID NO: 129, SEQ ID NO: 133, SEQ ID NO: 137, SEQ ID NO: 141, SEQ ID NO: 145, SEQ ID NO: 149, SEQ ID NO: 153, SEQ ID NO: 154, SEQ ID NO: 155, SEQ ID NO: 156, SEQ ID NO: 157, SEQ ID NO: 158, SEQ ID NO: 162, SEQ ID NO: 166, SEQ ID NO: 170, SEQ ID NO: 174, SEQ ID NO: 178, SEQ ID NO: 182, SEQ ID NO: 183, SEQ ID NO: 184, SEQ ID NO: 185, SEQ ID NO: 186, SEQ ID NO: 187, SEQ ID NO: 191, SEQ ID NO: 195, SEQ ID NO: 199, SEQ ID NO: 203, SEQ ID NO:207 and SEQ ID NO: 211.

11. The pharmaceutical composition according to claim 1, wherein said isolated mutated human or simian lentiviral ENV protein or said fragment of said isolated mutated human or simian lentiviral ENV protein comprises one of the amino acid sequences: SEQ ID NO: 96, SEQ ID NO: 97, SEQ ID NO: 98, SEQ ID NO: 99, SEQ ID NO: 100, SEQ ID NO: 104, SEQ ID NO: 125, SEQ ID NO: 126, SEQ ID NO: 127, SEQ ID NO: 128, SEQ ID NO: 129, SEQ ID NO: 133, SEQ ID NO: 154, SEQ ID NO: 155, SEQ ID NO: 156, SEQ ID NO: 157, SEQ ID NO: 158, SEQ ID NO: 162, SEQ ID NO: 183, SEQ ID NO: 184, SEQ ID NO: 185, SEQ ID NO: 186, SEQ ID NO: 187, SEQ ID NO: 191.

12. The pharmaceutical composition according to claim 1, wherein said isolated mutated human or simian lentiviral ENV protein consists of one of the amino acid sequences: SEQ ID NO: 212, SEQ ID NO: 213, SEQ ID NO: 214, SEQ ID NO: 215, SEQ ID NO: 216, SEQ ID NO: 220, SEQ ID NO: 224, SEQ ID NO: 228, SEQ ID NO: 232, SEQ ID NO: 236, SEQ ID NO: 240, SEQ ID NO: 241, SEQ ID NO: 242, SEQ ID NO: 243, SEQ ID NO: 244, SEQ ID NO: 245, SEQ ID NO: 249, SEQ ID NO: 253, SEQ ID NO: 257, SEQ ID NO: 261, SEQ ID NO: 265, SEQ ID NO: 269, SEQ ID NO: 420 and SEQ ID NO: 421.

13. The pharmaceutical composition according to claim 1, wherein said isolated mutated human or simian lentiviral ENV protein consists of one of the amino acid sequences: SEQ ID NO: 212, SEQ ID NO: 213, SEQ ID NO: 214, SEQ ID NO: 215, SEQ ID NO: 216, SEQ ID NO: 220, SEQ ID NO: 241, SEQ ID NO: 242, SEQ ID NO: 243, SEQ ID NO: 244, SEQ ID NO: 245, SEQ ID NO: 249, SEQ ID NO: 420 and SEQ ID NO: 421.

14. The pharmaceutical composition according to claim 1, wherein said mutated protein consists of one of the amino acid sequences of the group consisting of SEQ ID NO: 271 to 283.

15. The pharmaceutical composition according to claim 1, in association with at least one antiviral compound, preferably for a simultaneous, separated or sequential use.

16. The pharmaceutical composition according to claim 1, for its use for stimulating an immune response in a host organism.

17. A method to obtain the active substance of a pharmaceutical composition, as defined in claim 1, consisting of modifying the immunosuppressive property of:

a wild-type non-mutated human or simian lentiviral ENV protein, or a fragment of said wild-type non-mutated human or simian lentiviral ENV protein, said fragment comprising at least 40 amino acids, said wild-type non-mutated human or simian lentiviral ENV protein or fragment thereof presenting a transmembrane subunit (TM) comprising an immunosuppressive domain (ISU) containing the following amino acid sequence:

A-[I/V]-E-[K/R]-$X'_a$-$X'_b$-X-D-Q, (SEQ ID NO: 427)

wherein

X represents any amino acid, $X'_a$ is C, D, E, H, I, K, M, N, P, Q, S, T, V, W or Y, and $X'_b$ is C, D, E, H, I, K, L, M, N, P, Q, S, T, V, W or Y, said method comprising a step of introduction of at least one mutation of $X'_a$ and/or $X'_b$r to obtain:

an isolated mutated human or simian lentiviral ENV protein having no or a reduced immunosuppressive activity as compared to the wild type non-mutated human or simian lentiviral ENV protein, or a fragment of said isolated mutated human or simian lentiviral ENV protein having no or a reduced immunosuppressive activity as compared to the wild type non-mutated human or simian lentiviral ENV protein, said fragment comprising at least 40 amino acids, said isolated mutated human or simian lentiviral ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is any amino acid, $X_a$ is any amino acid, and $X_b$ is R, or $X_a$ is A, F, G, L or R, and $X_b$ is R, said substantial absence or reduction of immunosuppressive activity of the above mentioned mutated human or simian lentiviral ENV protein or of the above defined fragment being liable to be assessed by the fact that in an in vivo assay involving engrafted tumor cells rejection, said tumor cells being transduced either so as to express said mutated ENV protein or said fragment (mutated ENV tumor cells), or said tumor cells being transduced so as to express the corresponding wild type non-mutated ENV protein or a fragment thereof (wild type ENV tumor cells), or said tumor cells being not transduced (normal tumor cells), the following ratio:

immunosuppression index of said mutated ENV protein or of said fragment ($i_{mutated\ env}$)/immunosuppression index of wild type ENV protein ($i_{wild\ type\ env}$) is less than 0.5, $i_{mutated\ env}$ being defined by: (maximum area reached by mutated ENV tumor cells–maximum area reached by normal tumor cells)/(maximum area reached by normal tumor cells), and $i_{wild\ type\ env}$ being defined by: (maximum area reached by wild type ENV tumor cells–maximum area reached by normal tumor cells)/(maximum area reached by normal tumor cells).

18. A method to obtain the active substance of a pharmaceutical composition, as defined in claim 1, consisting of modifying the immunosuppressive property of:

a wild-type non-mutated human or simian lentiviral ENV protein, or a fragment of said wild-type non-mutated human or simian lentiviral ENV protein, said fragment comprising at least 40 amino acids, said wild-type non-mutated human or simian lentiviral ENV protein or fragment thereof presenting a transmembrane subunit (TM) comprising an immunosuppressive domain (ISU) containing the following amino acid sequence:

A-[I/V]-E-[K/R]-Y-L-X-D-Q, (SEQ ID NO: 1)

wherein

X represents any amino acid, said method comprising a step of introduction of at least one mutation of Y in position 5 and/or L in position 6, to obtain:

an isolated mutated human or simian lentiviral ENV protein having no or a reduced immunosuppressive activity as compared to the wild type non-mutated human or simian lentiviral ENV protein, or a fragment of said isolated mutated human or simian lentiviral ENV protein having no or a reduced immunosuppressive activity as compared to the wild type sequence, said fragment comprising at least 40 amino acids, said isolated mutated human or simian lentiviral ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, I, V, M or P, $X_a$ is Y, I, H, C or T, and $X_b$ is R, or $X_a$ is A, F, G, L or R, and $X_b$ is R.

19. A method to obtain the active substance of a pharmaceutical composition, as defined in claim 1, wherein said isolated mutated human or simian lentiviral ENV protein having no or a reduced immunosuppressive activity as compared to the wild type non-mutated human or simian lentiviral ENV protein, or a fragment of said isolated mutated human or simian lentiviral ENV protein having no or a reduced immunosuppressive activity as compared to the wild type non-mutated human or simian lentiviral ENV protein, said fragment comprising at least 40 amino acids, said isolated mutated human or simian lentiviral ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, $X_a$ is Y, and $X_b$ is R, or $X_a$ is A, F, G, L or R, and $X_b$ is R.

20. A method to obtain the active substance of a pharmaceutical composition, as defined in claim 1, wherein said isolated mutated human or simian lentiviral ENV protein having no or a reduced immunosuppressive activity as compared to the wild type non-mutated human or simian lentiviral ENV protein, or a fragment of said isolated mutated human or simian lentiviral ENV protein having no or a reduced immunosuppressive activity as compared to the wild type non-mutated human or simian lentiviral ENV protein, said fragment comprising at least 40 amino acids, said isolated mutated human or simian lentiviral ENV protein and fragment thereof comprising a mutated immunosuppressive domain (ISU) containing the following amino sequence:

A-[I/V]-E-[K/R]-$X_a$-$X_b$-X-D-Q, (SEQ ID NO: 416)

wherein

X represents any amino acid, and either $X_a$ is A, F, G, L or R, and $X_b$ is L, or $X_a$ is Y, and $X_b$ is R.

21. The pharmaceutical composition according to claim 1, wherein said isolated mutated human lentiviral ENV protein or said fragment of said isolated mutated human lentiviral ENV protein has no or a reduced immunosuppressive activity as compared to a wild type non-mutated HIV-1 ENV protein consisting of the amino acid sequence SEQ ID NO: 417.

22. The pharmaceutical composition according to claim 1, wherein said isolated mutated human lentiviral ENV protein or said fragment of said isolated mutated human lentiviral ENV protein has no or a reduced immunosuppressive activity as compared to a wild type non-mutated HIV-2 ENV protein consisting of the amino acid sequence SEQ ID NO: 418.

23. The pharmaceutical composition according to claim 1, wherein said isolated mutated simian lentiviral ENV protein or said fragment of said isolated mutated simian lentiviral ENV protein has no or a reduced immunosuppressive activity as compared to a wild type non-mutated SIV ENV protein consisting of the amino acid sequence SEQ ID NO: 419.

24. The pharmaceutical composition according to claim 1, wherein said isolated mutated human lentiviral ENV protein or said fragment of said isolated mutated human lentiviral ENV protein has no or a reduced immunosuppressive activity as compared to a HIV-1 ENV protein comprising a wild type non-mutated immunosuppressive domain selected from the group consisting of: SEQ ID NO: 366, SEQ ID NO: 367, SEQ ID NO: 368, SEQ ID NO: 369, SEQ ID NO: 370 and SEQ ID NO: 371.

25. The pharmaceutical composition according to claim 1, wherein said isolated mutated human lentiviral ENV protein or said fragment of said isolated mutated human lentiviral ENV protein has no or a reduced immunosuppressive activity as compared to a HIV-2 ENV protein comprising a wild type non-mutated immunosuppressive domain selected from the group consisting of: SEQ ID NO: 376 and SEQ ID NO: 377.

26. The pharmaceutical composition according to claim 1, wherein said isolated mutated simian lentiviral ENV protein or said fragment of said isolated mutated simian lentiviral ENV protein has no or a reduced immunosuppressive activity as compared to a SIV ENV protein comprising a wild type non-mutated immunosuppressive domain selected from the group consisting of: SEQ ID NO: 372, SEQ ID NO: 373, SEQ ID NO: 374 and SEQ ID NO: 375.

* * * * *